US011584931B2

(12) United States Patent
Weinberger et al.

(10) Patent No.: US 11,584,931 B2
(45) Date of Patent: Feb. 21, 2023

(54) METHODS AND COMPOSITIONS FOR GENERATING A DELETION LIBRARY AND FOR IDENTIFYING A DEFECTIVE INTERFERING PARTICLE (DIP)

(71) Applicants: The J. David Gladstone Institutes, a testamentary trust established under the Will of J. David Gladstone, San Francisco, CA (US); The Regents of the University of California, Oakland, CA (US)

(72) Inventors: Leor S. Weinberger, Oakland, CA (US); Timothy J. Notton, San Francisco, CA (US)

(73) Assignees: The J. David Gladstone Institutes, San Francisco, CA (US), a testamentary trust established under the Will of J. David Gladstone; The Regents of the University of California, Oakland, CA (US)

( * ) Notice: Subject to any disclaimer, the term of this patent is extended or adjusted under 35 U.S.C. 154(b) by 521 days.

(21) Appl. No.: 16/467,233

(22) PCT Filed: Dec. 14, 2017

(86) PCT No.: PCT/US2017/066462
§ 371 (c)(1),
(2) Date: Jun. 6, 2019

(87) PCT Pub. No.: WO2018/112225
PCT Pub. Date: Jun. 21, 2018

(65) Prior Publication Data
US 2021/0024921 A1 Jan. 28, 2021

Related U.S. Application Data

(60) Provisional application No. 62/434,322, filed on Dec. 14, 2016.

(51) Int. Cl.
C12N 15/10 (2006.01)
C12Q 1/6806 (2018.01)
C12Q 1/6869 (2018.01)
C12N 15/66 (2006.01)
C12N 15/867 (2006.01)

(52) U.S. Cl.
CPC ......... C12N 15/1082 (2013.01); C12N 15/10 (2013.01); C12N 15/1065 (2013.01); C12N 15/66 (2013.01); C12Q 1/6806 (2013.01); C12Q 1/6869 (2013.01); C12N 15/1093 (2013.01); C12N 15/867 (2013.01); C12N 2310/533 (2013.01); C12N 2740/16021 (2013.01); C12N 2740/16062 (2013.01); C12N 2800/107 (2013.01); C12N 2800/80 (2013.01); C12N 2800/90 (2013.01); C12Q 2563/185 (2013.01)

(58) Field of Classification Search
None
See application file for complete search history.

(56) References Cited

U.S. PATENT DOCUMENTS

| 2006/0019301 | A1 | 1/2006 | Hansen et al. |
| 2010/0184832 | A1 | 7/2010 | Pugachev et al. |
| 2011/0117072 | A1 | 5/2011 | Izsvak et al. |
| 2011/0151434 | A1 | 6/2011 | Gao et al. |
| 2015/0368670 | A1 | 12/2015 | Quake et al. |
| 2016/0015759 | A1 | 1/2016 | Weinberger et al. |

FOREIGN PATENT DOCUMENTS

WO 2018112225 6/2018

OTHER PUBLICATIONS

Huang, Defective Interfering Viruses 27 Annual Review of Microbiology 101-118 (Year: 1973).*
"International Application Serial No. PCT US2017 066462, International Preliminary Report on Patentability dated Jun. 27, 2019", 12 pgs.
"International Application Serial No. PCT US2017 066462, International Search Report dated Apr. 20, 2018", 7 pgs.
"International Application Serial No. PCT US2017 066462, Written Opinion dated Apr. 20, 2018", 10 pgs.
Goryshin, "Chromosomal Deletion Formation System Based on Tn5 Double Transposition: Use For Making Minimal Genomes and Essential Gene Analysis", Genome Res. 2003, vol. 13(4), 644-53.
Zhao, "Realizing Directional Cloning using Sticky ends Produced by 3'-5' Exonuclease of Klenow Fragment", J Biosci. 2013, vol. 38(5), (2013), 857-66.

* cited by examiner

Primary Examiner — Nancy J Leith
(74) Attorney, Agent, or Firm — Schwegman Lundberg & Woessner, P.A.

(57) ABSTRACT

Provided are methods and compositions for generating a deletion library, and methods and compositions for generating and identifying a defective interfering particle (DIP). Also provided are transposon cassettes. A subject method can include: inserting a transposon cassette comprising a target sequence for a sequence specific DNA endonuclease into a population of circular target DNAs to generate a population of transposon-inserted circular target DNAs; contacting the population of transposon-inserted circular target DNAs with the sequence specific DNA endonuclease to generate a population of cleaved linear target DNAs; contacting the population of cleaved linear target DNAs with one or more exonucleases to generate a population of deletion DNAs; and circularizing the deletion DNAs to generate a library of circularized deletion DNAs. The population of circular target DNAs can include viral genomic DNA. Also provided are human immunodeficiency virus (HIV) deletion mutants, e.g., interfering, conditionally replicating, HIV deletion mutants, and related constructs.

9 Claims, 51 Drawing Sheets
Specification includes a Sequence Listing.

| I-SceI (17 bp) | 3 stops (6 frames) | I-CeuI (26 bp) |

5' tagggataacagggtaattttagttagttagttaactataacggtcctaaggtagcgaa
3' atccctattgtcccattaaatcaatcaatcaattgatattgccaggattccatcgctt Figure 11
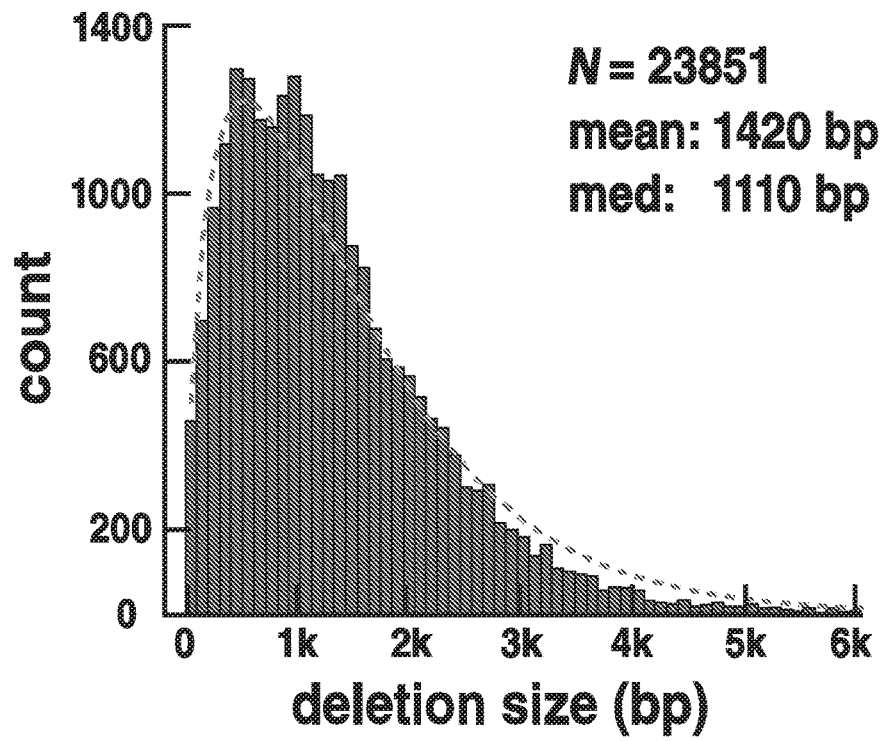
Figure 12
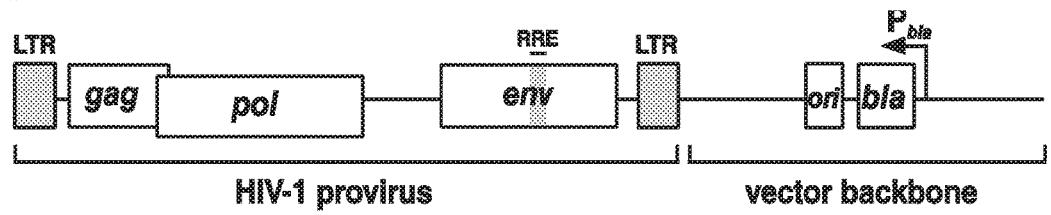
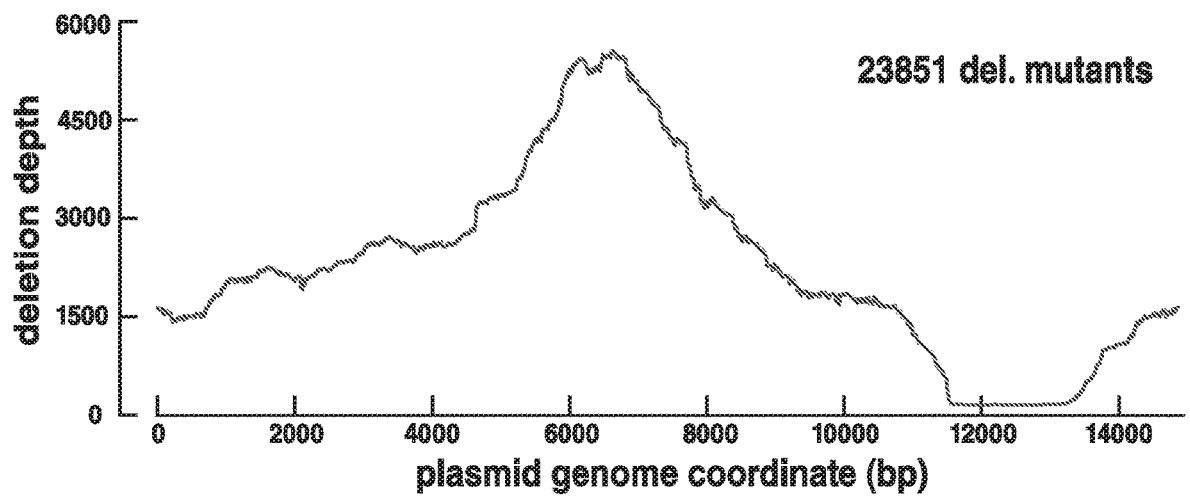

d0: Transfect 293T with proviral plasmids d2: Harvest virus Infect MT4 d4: Assess MT4 infection

Figure 20
pTN5MC
Tn5 transposon, meganuclease sites, chloramphenicol resistance, full plasmid; circular, 3984 bp
TCGCGCGTTTCGGTGATGACGGTGAAAACCTCTGACACATGCAGCTCCCGGAGACGGTCACAGCTTGTCT
GTAAGCGGATGCCGGGAGCAGACAAGCCCGTCAGGGCGCGTCAGCGGGTGTTGGCGGGTGTCGGGGCTGG
CTTAACTATGCGGCATCAGAGCAGATTGTACTGAGAGTGCACCATATGCGGTGTGAAATACCGCACAGAT
GCGTAAGGAGAAAATACCGCATCAGGCGCCATTCGCCATTCAGGCTGCGCAACTGTTGGGAAGGGCGATC
GGTGCGGGCCTCTTCGCTATTACGCCAGCTGGCGAAAGGGGGATGTGCTGCAAGGCGATTAAGTTGGGTA
ACGCCAGGGTTTTCCCAGTCACGACGTTGTAAAACGACGGCCAGTGAATTCGAGCTCGGTACCCGGGCTG
TCTCTTATACACATCTgcggccgcTAGGGATAACAGGGTAATtagttagttagtTAACTATAACGGTCC
TAAGGTAGCGAAAGATCTTAAGTAAGTAAGAGTATACGTATATCGGTAAtaacgtaTTaAGGCGCTTCG
GCGCCttttttatgGGGGTATTTTCATCCCAATCCACACGTCCAACGCACAGCAAACACCACGTCGACC
CTATCAGCTGCGTGCTTTCTATGAGTCGTTGCTGCAtaacAAAAAATTTATTTGCTTATTAATTCATCCG
GCTCGTATAATGTGTGGAGGGCCCAAGTTCACTTAAAAAGGAGATCAACAATGAAAGCAATTTTCGTACT
GAAACATCTTAATCATGCTAAGGAGGTTTTCTATGgagaaaaaaatcactggatataccaccgttgatat
atcccaatggcatcgtaaagaacattttgaggcatttcagtcagttgctcaatgtacctataaccagacc
gttcagctggatattacggccttttaaagaccgtaaagaaaaataagcacaagttttatccggccttta
ttcacattcttgcccgcctgatgaatgctcatccggaattccgtatggcaatgaaagacggtgagctggt
gatatgggatagtgttcaccttgttacaccgttttccatgagcaaactgaaacgttttcatcgctctgg
agtgaataccacgacgatttccggcagtttctacacatatattcgcaagatgtggcgtgttacggtgaaa
acctggcctatttccctaaagggtttattgagaatatgttttcgtctcagccaatccctgggtgagttt
caccagttttgatttaaacgtggccaatatggacaacttcttcgccccgttttcaccatgggcaaatat
tatacgcaaggcgacaaggtgctgatgccgctggcgattcaggttcatcatgccgtttgtgatggcttcc
atgtcggcagaatgcttaatgaattacaacagtactgcgatgagtggcagggcggggcgTAAggatcggt
tgtcgagtaaggatctccaggcatcaaataaaacgaaaggctcagtcgaaagactgggcctttcgtttta
tctgttgtttgtcggtgaacgctctctactagagtcacactggctcaccttcgggtgggcctttctgcgt
ttataggatcctaactcgagTAGGGATAACAGGGTAATtagttagttagtTAACTATAACGGTCCTAAG
GTAGCGAAttaattaaAGATGTGTATAAGAGACAGGATCCTCTAGAGTCGACCTGCAGGCATGCAAGCTT
GGCGTAATCATGGTCATAGCTGTTTCCTGTGTGAAATTGTTATCCGCTCACAATTCCACACAACATACGA
GCCGGAAGCATAAAGTGTAAAGCCTGGGGTGCCTAATGAGTGAGCTAACTCACATTAATTGCGTTGCGCT
CACTGCCCGCTTTCCAGTCGGGAAACCTGTCGTGCCAGCTGCATTAATGAATCGGCCAACGCGCGGGGAG
AGGCGGTTTGCGTATTGGGCGCTCTTCCGCTTCCTCGCTCACTGACTCGCTGCGCTCGGTCGTTCGGCTG
CGGCGAGCGGTATCAGCTCACTCAAAGGCGGTAATACGGTTATCCACAGAATCAGGGGATAACGCAGGAA
AGAACATGTGAGCAAAAGGCCAGCAAAAGGCCAGGAACCGTAAAAAGGCCGCGTTGCTGGCGTTTTTCCA
TAGGCTCCGCCCCCCTGACGAGCATCACAAAAATCGACGCTCAAGTCAGAGGTGGCGAAACCCGACAGGA
CTATAAAGATACCAGGCGTTTCCCCCTGGAAGCTCCCTCGTGCGCTCTCCTGTTCCGACCCTGCCGCTTA
CCGGATACCTGTCCGCCTTTCTCCCTTCGGGAAGCGTGGCGCTTTCTCATAGCTCACGCTGTAGGTATCT
CAGTTCGGTGTAGGTCGTTCGCTCCAAGCTGGGCTGTGTGCACGAACCCCCCGTTCAGCCCGACCGCTGC
GCCTTATCCGGTAACTATCGTCTTGAGTCCAACCCGGTAAGACACGACTTATCGCCACTGGCAGCAGCCA
CTGGTAACAGGATTAGCAGAGCGAGGTATGTAGGCGGTGCTACAGAGTTCTTGAAGTGGTGGCCTAACTA
CGGCTACACTAGAAGAACAGTATTTGGTATCTGCGCTCTGCTGAAGCCAGTTACCTTCGGAAAAAGAGTT
GGTAGCTCTTGATCCGGCAAACAAACCACCGCTGGTAGCGGTGGTTTTTTTGTTTGCAAGCAGCAGATTA
CGCGCAGAAAAAAGGATCTCAAGAAGATCCTTTGATCTTTTCTACGGGGTCTGACGCTCAGTGGAACGA
AAACTCACGTTAAGGGATTTTGGTCATGAGATTATCAAAAGGATCTTCACCTAGATCCTTTTAAATTAA
AAATGAAGTTTTAAATCAATCTAAAGTATATATGAGTAAACTTGGTCTGACAGTTACCAATGCTTAATCA
GTGAGGCACCTATCTCAGCGATCTGTCTATTTCGTTCATCCATAGTTGCCTGACTCCCCGTCGTGTAGAT

Figure 20 (Cont. 1)

```
AACTACGATACGGGAGGGCTTACCATCTGGCCCCAGTGCTGCAATGATACCGCGAGACCCACGCTCACCG
GCTCCAGATTTATCAGCAATAAACCAGCCAGCCGGAAGGGCCGAGCGCAGAAGTGGTCCTGCAACTTTAT
CCGCCTCCATCCAGTCTATTAATTGTTGCCGGGAAGCTAGAGTAAGTAGTTCGCCAGTTAATAGTTTGCG
CAACGTTGTTGCCATTGCTACAGGCATCGTGGTGTCACGCTCGTCGTTTGGTATGGCTTCATTCAGCTCC
GGTTCCCAACGATCAAGGCGAGTTACATGATCCCCATGTTGTGCAAAAAAGCGGTTAGCTCCTTCGGTC
CTCCGATCGTTGTCAGAAGTAAGTTGGCCGCAGTGTTATCACTCATGGTTATGGCAGCACTGCATAATTC
TCTTACTGTCATGCCATCCGTAAGATGCTTTTCTGTGACTGGTGAGTACTCAACCAAGTCATTCTGAGAA
TAGTGTATGCGGCGACCGAGTTGCTCTTGCCCGGCGTCAATACGGGATAATACCGCGCCACATAGCAGAA
CTTTAAAAGTGCTCATCATTGGAAAACGTTCTTCGGGGCGAAAACTCTCAAGGATCTTACCGCTGTTGAG
ATCCAGTTCGATGTAACCCACTCGTGCACCCAACTGATCTTCAGCATCTTTTACTTTCACCAGCGTTTCT
GGGTGAGCAAAAACAGGAAGGCAAAATGCCGCAAAAAAGGGAATAAGGGCGACACGGAAATGTTGAATAC
TCATACTCTTCCTTTTTCAATATTATTGAAGCATTTATCAGGGTTATTGTCTCATGAGCGGATACATATT
TGAATGTATTTAGAAAAATAAACAAATAGGGGTTCCGCGCACATTTCCCCGAAAAGTGCCACCTGACGTC
TAAGAAACCATTATTATCATGACATTAACCTATAAAAATAGGCGTATCACGAGGCCCTTTCGTC
(SEQ ID NO: 3)
``` pTN5MK
Tn5 transposon, meganuclease sites, kanamycin resistance, full plasmid; circular, 4121 bp

```
TCGCGCGTTTCGGTGATGACGGTGAAAACCTCTGACACATGCAGCTCCCGGAGACGGTCACAGCTTGTCT
GTAAGCGGATGCCGGGAGCAGACAAGCCCGTCAGGGCGCGTCAGCGGGTGTTGGCGGGTGTCGGGGCTGG
CTTAACTATGCGGCATCAGAGCAGATTGTACTGAGAGTGCACCATATGCGGTGTGAAATACCGCACAGAT
GCGTAAGGAGAAAATACCGCATCAGGCGCCATTCGCCATTCAGGCTGCGCAACTGTTGGGAAGGGCGATC
GGTGCGGGCCTCTTCGCTATTACGCCAGCTGGCGAAAGGGGGATGTGCTGCAAGGCGATTAAGTTGGGTA
ACGCCAGGGTTTTCCCAGTCACGACGTTGTAAAACGACGGCCAGTGAATTCGAGCTCGGTACCCGGGCTG
TCTCTTATACACATCTgcggccgcTAGGGATAACAGGGTAATttagttagttagtTAACTATAACGGTCC
TAAGGTAGCGAAAGATCTTAAGTAAGTAAGAGTATACGTATATCGGCTAAtaacgtaTTaAGGCGCTTCG
GCGCCttttttttatgGGGGTATTTTCATCCCAATCCACACGTCCAACGCACAGCAAACACCACGTCGACC
CTATCAGCTGCGTGCTTTCTATGAGTCGTTGCTGCAtaacAAAAAATTTATTTGCTTATTAATTCATCCG
GCTTCGTATAATGTGTGGAGGGCCCAAGTTCACTTAAAAAGGAGATCAACAATGAAAGCAATTTTCGTAC
TGAAACATCTTAATCATGCTAAGGAGGTTTTCTAATGattgaacaagatggattgcacgcaggttctccg
gccgcttgggtggagaggctattcggctatgactgggcacaacagacaatcggctgctctgatgccgccg
tgttccggctgtcagcgcaggggcgcccggttcttttgtcaagaccgacctgtccggtgccctgaatga
actgcaggacgaggcagcgcggctatcgtggctggccacgacgggcgttccttgcgcagctgtgctcgac
gttgtcactgaagcgggaagggactggctgctattgggcgaagtgccggggcaggatctcctgtcatctc
accttgctcctgccgagaaagtatccatcatggctgatgcaatgcggcggctgcatacgcttgatccggc
tacctgcccattcgaccaccaagcgaaacatcgcatcgagcgagcacgtactcggatggaagccggtctt
gtcgatcaggatgatctggacgaagagcatcaggggctcgcgccagccgaactgttcgccaggctcaagg
cgcgcatgcccgacggcgaggatctcgtcgtgacccatggcgatgcctgcttgccgaatatcatggtgga
aaatggccgcttttctggattcatcgactgtggccggctgggtgtggcggaccgctatcaggacatagcg
ttggctacccgtgatattgctgaagagcttggcggcgaatgggctgaccgcttcctcgtgctttacggta
tcgccgctcccgattcgcagcgcatcgccttctatcgccttcttgacgagttcttcTAAggatcggttgt
cgagtaaggatctccaggcatcaaataaaacgaaaggctcagtcgaaagactgggcctttcgttttatct
gttgtttgtcggtgaacgctctctactagagtcacactggctcaccttcgggtgggcctttctgcgttta
```

Figure 20 (Cont. 2)

```
taggatcctaactcgagTAGGGATAACAGGGTAATttagttagttagtTAACTATAACGGTCCTAAGGTA
GCGAAttaattaaAGATGTGTATAAGAGACAGGATCCTCTAGAGTCGACCTGCAGGCATGCAAGCTTGGC
GTAATCATGGTCATAGCTGTTTCCTGTGTGAAATTGTTATCCGCTCACAATTCCACACAACATACGAGCC
GGAAGCATAAAGTGTAAAGCCTGGGGTGCCTAATGAGTGAGCTAACTCACATTAATTGCGTTGCGCTCAC
TGCCCGCTTTCCAGTCGGGAAACCTGTCGTGCCAGCTGCATTAATGAATCGGCCAACGCGCGGGGAGAGG
CGGTTTGCGTATTGGGCGCTCTTCCGCTTCCTCGCTCACTGACTCGCTGCGCTCGGTCGTTCGGCTGCGG
CGAGCGGTATCAGCTCACTCAAAGGCGGTAATACGGTTATCCACAGAATCAGGGGATAACGCAGGAAAGA
ACATGTGAGCAAAAGGCCAGCAAAAGGCCAGGAACCGTAAAAAGGCCGCGTTGCTGGCGTTTTTCCATAG
GCTCCGCCCCCTGACGAGCATCACAAAAATCGACGCTCAAGTCAGAGGTGGCGAAACCCGACAGGACTA
TAAAGATACCAGGCGTTTCCCCCTGGAAGCTCCCTCGTGCGCTCTCCTGTTCCGACCCTGCCGCTTACCG
GATACCTGTCCGCCTTTCTCCCTTCGGGAAGCGTGGCGCTTTCTCATAGCTCACGCTGTAGGTATCTCAG
TTCGGTGTAGGTCGTTCGCTCCAAGCTGGGCTGTGTGCACGAACCCCCGTTCAGCCCGACCGCTGCGCC
TTATCCGGTAACTATCGTCTTGAGTCCAACCCGGTAAGACACGACTTATCGCCACTGGCAGCAGCCACTG
GTAACAGGATTAGCAGAGCGAGGTATGTAGGCGGTGCTACAGAGTTCTTGAAGTGGTGGCCTAACTACGG
CTACACTAGAAGAACAGTATTTGGTATCTGCGCTCTGCTGAAGCCAGTTACCTTCGGAAAAAGAGTTGGT
AGCTCTTGATCCGGCAAACAAACCACCGCTGGTAGCGGTGGTTTTTTTGTTTGCAAGCAGCAGATTACGC
GCAGAAAAAAAGGATCTCAAGAAGATCCTTTGATCTTTTCTACGGGGTCTGACGCTCAGTGGAACGAAAA
CTCACGTTAAGGGATTTTGGTCATGAGATTATCAAAAAGGATCTTCACCTAGATCCTTTTAAATTAAAAA
TGAAGTTTTAAATCAATCTAAAGTATATATGAGTAAACTTGGTCTGACAGTTACCAATGCTTAATCAGTG
AGGCACCTATCTCAGCGATCTGTCTATTTCGTTCATCCATAGTTGCCTGACTCCCCGTCGTGTAGATAAC
TACGATACGGGAGGGCTTACCATCTGGCCCCAGTGCTGCAATGATACCGCGAGACCCACGCTCACCGGCT
CCAGATTTATCAGCAATAAACCAGCCAGCCGGAAGGGCCGAGCGCAGAAGTGGTCCTGCAACTTTATCCG
CCTCCATCCAGTCTATTAATTGTTGCCGGGAAGCTAGAGTAAGTAGTTCGCCAGTTAATAGTTTGCGCAA
CGTTGTTGCCATTGCTACAGGCATCGTGGTGTCACGCTCGTCGTTTGGTATGGCTTCATTCAGCTCCGGT
TCCCAACGATCAAGGCGAGTTACATGATCCCCCATGTTGTGCAAAAAAGCGGTTAGCTCCTTCGGTCCTC
CGATCGTTGTCAGAAGTAAGTTGGCCGCAGTGTTATCACTCATGGTTATGGCAGCACTGCATAATTCTCT
TACTGTCATGCCATCCGTAAGATGCTTTTCTGTGACTGGTGAGTACTCAACCAAGTCATTCTGAGAATAG
TGTATGCGGCGACCGAGTTGCTCTTGCCCGGCGTCAATACGGGATAATACCGCGCCACATAGCAGAACTT
TAAAAGTGCTCATCATTGGAAAACGTTCTTCGGGGCGAAAACTCTCAAGGATCTTACCGCTGTTGAGATC
CAGTTCGATGTAACCCACTCGTGCACCCAACTGATCTTCAGCATCTTTTACTTTCACCAGCGTTTCTGGG
TGAGCAAAAACAGGAAGGCAAAATGCCGCAAAAAAGGGAATAAGGGCGACACGGAAATGTTGAATACTCA
TACTCTTCCTTTTTCAATATTATTGAAGCATTTATCAGGGTTATTGTCTCATGAGCGGATACATATTTGA
ATGTATTTAGAAAAATAAACAAATAGGGGTTCCGCGCACATTTCCCCGAAAAGTGCCACCTGACGTCTAA
GAAACCATTATTATCATGACATTAACCTATAAAAATAGGCGTATCACGAGGCCCTTTCGTC
(SEQ ID NO: 4)
```

TN5MC
Tn5 transposon, meganuclease sites, chloramphenicol resistance, transposon sequence;
linear, 1298 bp

```
CTGTCTCTTATACACATCTgcggccgcTAGGGATAACAGGGTAATttagttagttagtTAACTATAACGG
TCCTAAGGTAGCGAAAGATCTTAAGTAAGTAAGAGTATACGTATATCGGCTAAtaacgtaTTaAGGCGCT
TCGGCGCCttttttttatgGGGGTATTTTCATCCCAATCCACACGTCCAACGCACAGCAAACACCACGTCG
ACCCTATCAGCTGCGTGCTTTCTATGAGTCGTTGCTGCAtaacAAAAAATTTATTTGCTTATTAATTCAT
CCGGCTCGTATAATGTGTGGAGGGCCCAAGTTCACTTAAAAAGGAGATCAACAATGAAAGCAATTTTCGT
ACTGAAACATCTTAATCATGCTAAGGAGGTTTTCTATGgagaaaaaaatcactggatataccaccgttga
tatatcccaatggcatcgtaaagaacatttttgaggcatttcagtcagttgctcaatgtacctataaccag
```

Figure 20 (Cont. 3)
accgttcagctggatattacggcctttttaaagaccgtaaagaaaaataagcacaagttttatccggcct
ttattcacattcttgcccgcctgatgaatgctcatccggaattccgtatggcaatgaaagacggtgagct
ggtgatatgggatagtgttcaccttgttacaccgttttccatgagcaaactgaaacgttttcatcgctc
tggagtgaataccacgacgatttccggcagtttctacacatatattcgcaagatgtggcgtgttacggtg
aaaacctggcctatttccctaaaggggtttattgagaatatgttttcgtctcagccaatccctgggtgag
tttcaccagttttgatttaaacgtggccaatatggacaacttcttcgccccgttttcaccatgggcaaa
tattatacgcaaggcgacaaggtgctgatgccgctggcgattcaggttcatcatgccgtttgtgatggct
tccatgtcggcagaatgcttaatgaattacaacagtactgcgatgagtggcagggcggggcgTAAggatc
ggttgtcgagtaaggatctccaggcatcaaataaaacgaaaggctcagtcgaaagactgggcctttcgtt
ttatctgttgtttgtcggtgaacgctctctactagagtcacactggctcaccttcgggtgggcctttctg
cgtttataggatcctaactcgagTAGGGATAACAGGGTAATttagttagttagtTAACTATAACGGTCCT
AAGGTAGCGAAttaattaaAGATGTGTATAAGAGACAG
(SEQ ID NO: 5)

TN5MK
Tn5 transposon, meganuclease sites, kanamycin resistance, transposon sequence;
linear, 1435 bp
CTGTCTCTTATACACATCTgcggccgcTAGGGATAACAGGGTAATttagttagttagtTAACTATAACGG
TCCTAAGGTAGCGAAAGATCTTAAGTAAGTAAGAGTATACGTATATCGGCTAAtaacgtaTTaAGGCGCT
TCGGCGCCttttttttatgGGGGTATTTTCATCCCAATCCACACGTCCAACGCACAGCAAACACCACGTCG
ACCCTATCAGCTGCGTGCTTTCTATGAGTCGTTGCTGCAtaacAAAAAATTTATTTGCTTATTAATTCAT
CCGGCTTCGTATAATGTGTGGAGGGCCCAAGTTCACTTAAAAAGGAGATCAACAATGAAAGCAATTTTCG
TACTGAAACATCTTAATCATGCTAAGGAGGTTTTCTAATGattgaacaagatggattgcacgcaggttct
ccggccgcttgggtggagaggctattcggctatgactgggcacaacagacaatcggctgctctgatgccg
ccgtgttccggctgtcagcgcaggggcgcccggttcttttttgtcaagaccgacctgtccggtgccctgaa
tgaactgcaggacgaggcagcgcggctatcgtggctggccacgacgggcgttccttgcgcagctgtgctc
gacgttgtcactgaagcgggaagggactggctgctattgggcgaagtgccggggcaggatctcctgtcat
ctcaccttgctcctgccgagaaagtatccatcatggctgatgcaatgcggcggctgcatacgcttgatcc
ggctacctgcccattcgaccaccaagcgaaacatcgcatcgagcgagcacgtactcggatggaagccggt
cttgtcgatcaggatgatctggacgaagagcatcaggggctcgcgccagccgaactgttcgccaggctca
aggcgcgcatgcccgacggcgaggatctcgtcgtgacccatggcgatgcctgcttgccgaatatcatggt
ggaaaatggccgcttttctggattcatcgactgtggccggctgggtgtggcggaccgctatcaggacata
gcgttggctacccgtgatattgctgaagagcttggcggcgaatgggctgaccgcttcctcgtgctttacg
gtatcgccgctcccgattcgcagcgcatcgccttctatcgccttcttgacgagttcttcTAAggatcggt
tgtcgagtaaggatctccaggcatcaaataaaacgaaaggctcagtcgaaagactgggcctttcgtttta
tctgttgtttgtcggtgaacgctctctactagagtcacactggctcaccttcgggtgggcctttctgcgt
ttataggatcctaactcgagTAGGGATAACAGGGTAATttagttagttagtTAACTATAACGGTCCTAAG
GTAGCGAAttaattaaAGATGTGTATAAGAGACAG
(SEQ ID NO: 6)

Figure 21

| description | pNL4-3Δ$_1$ |
| --- | --- |
| parental plasmid size (C) | 14,825 |
| genome length (v$_0$ length) | 9709 bp |
| plated size (CFU) | 110,000 |
| sequencing library | LTN3A-01 |
| read type | 2× 125 bp |
| number of PF clusters | 148,418,934 |
| reads with barcode | 4,356,618 (2.9%) |
| number of barcodes | 116,427 |
| number of unique barcodes | 25,095 |
| number of mappable deletions | 23,851 |
| mean deletion size | 1,420 bp |
| median deletion size | 1,110 bp |
| stdev. of deletion size | 712 bp |

Figure 25 (Cont. 1)
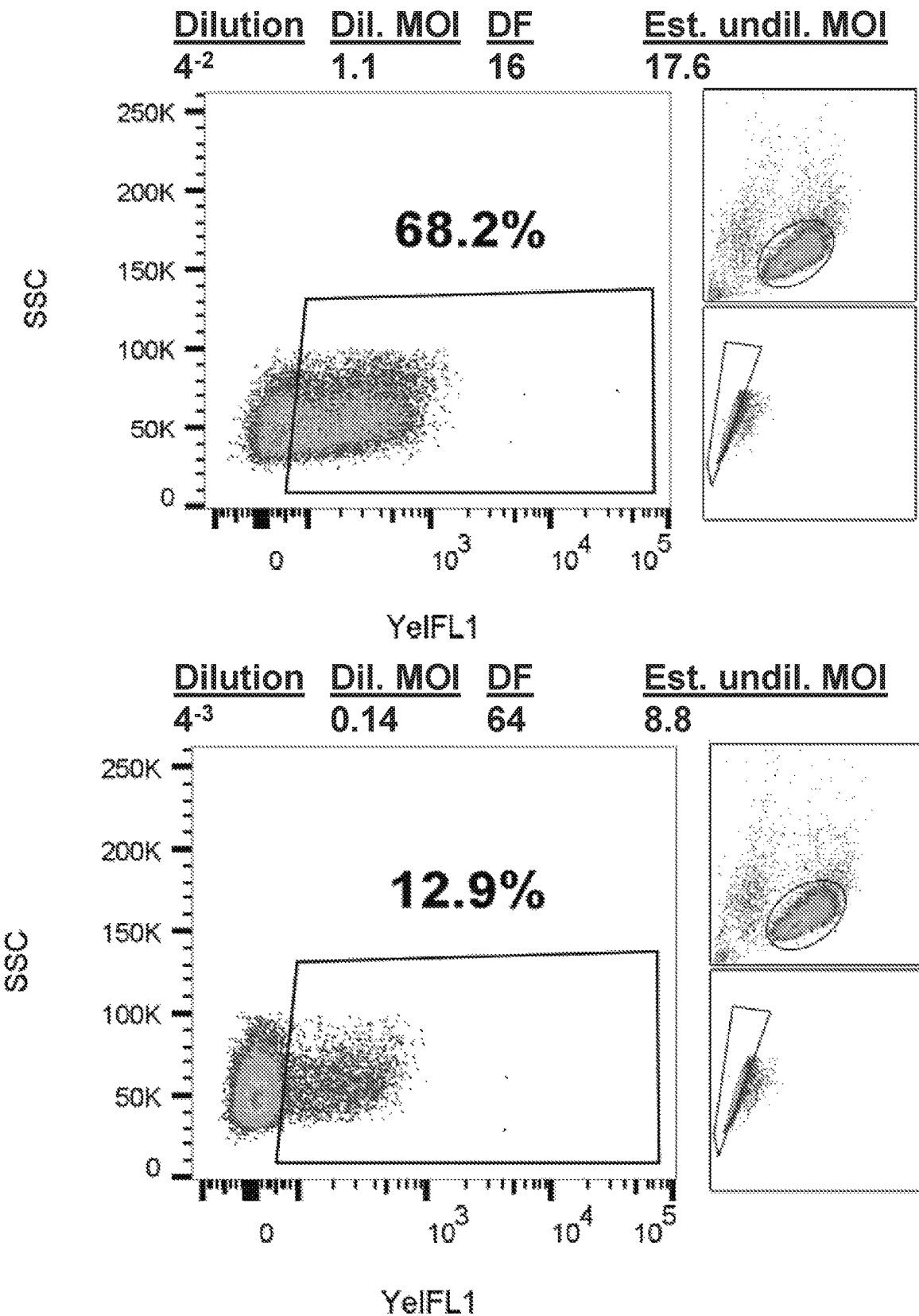

Figure 25 (Cont. 2)
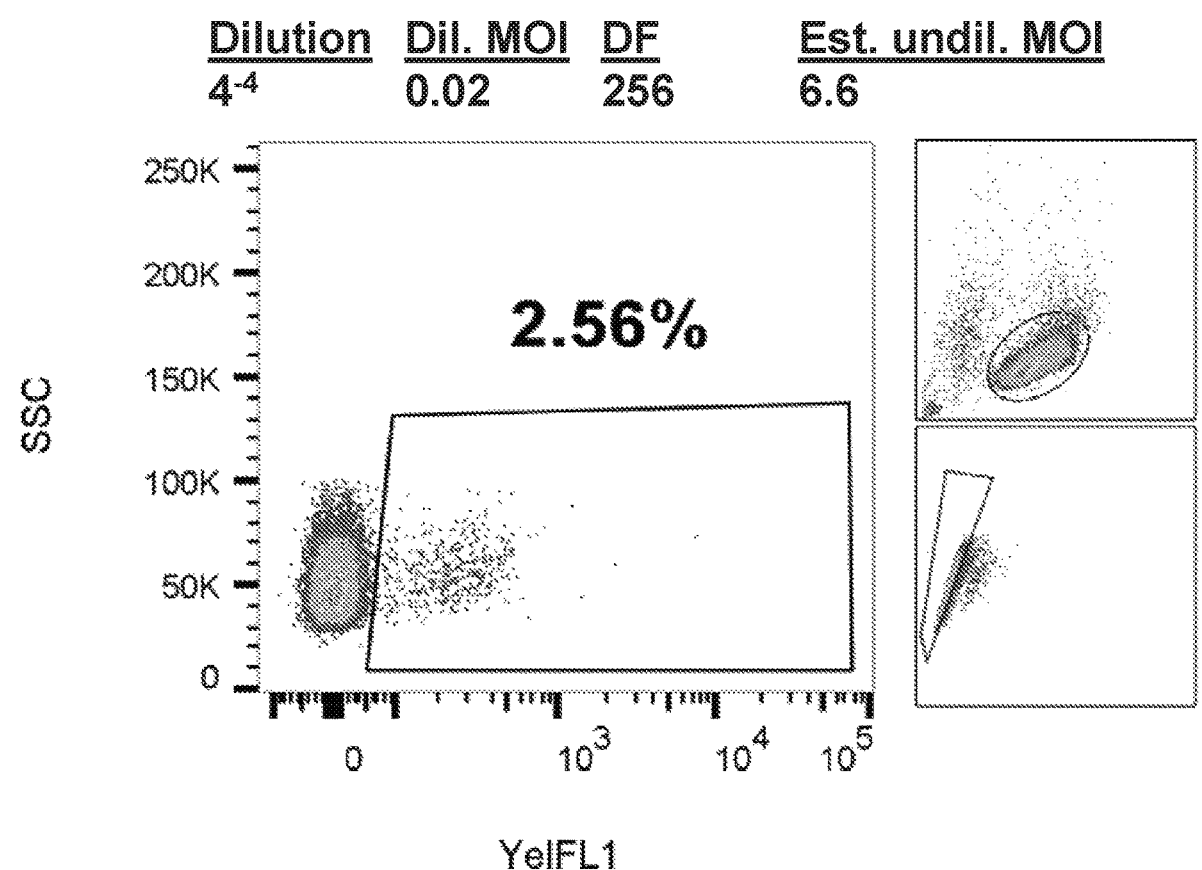

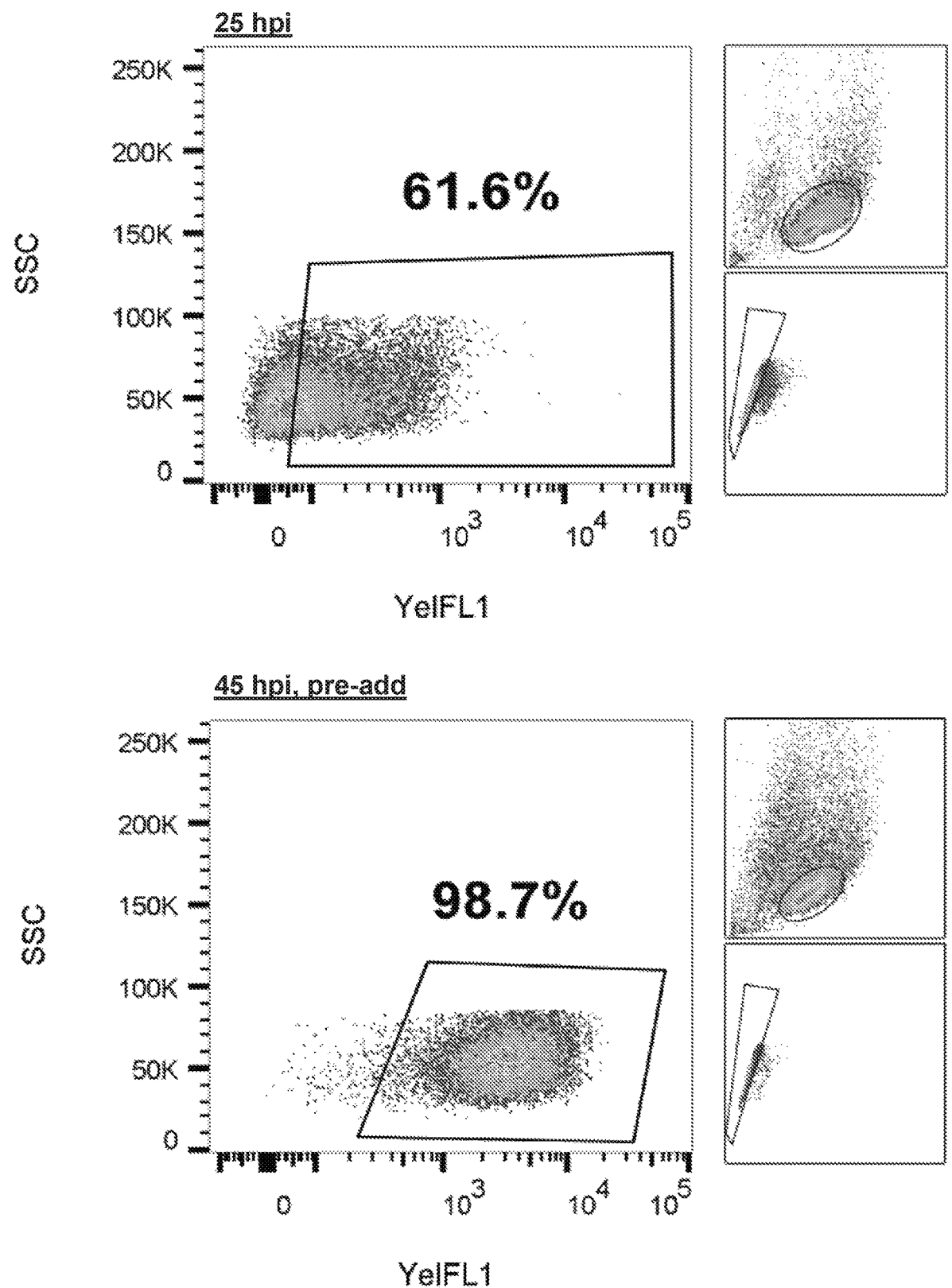
Figure 27 (Cont. 1)   Flask A, NL4-3 only

Figure 27 (Cont. 2)    Flask A, NL4-3 only
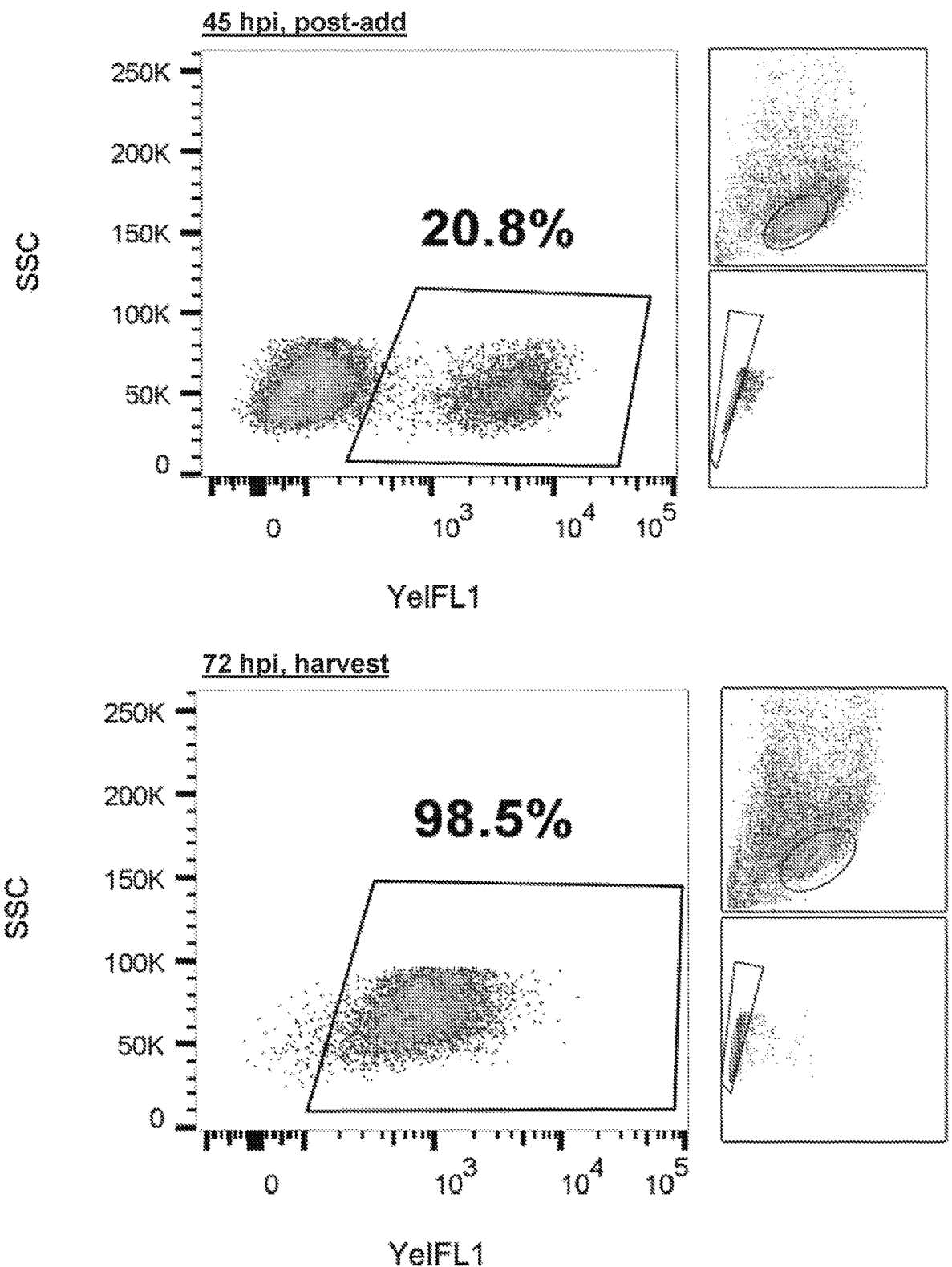

Figure 27 (Cont. 3)   Flask K, NL4-3 + del. Lib.
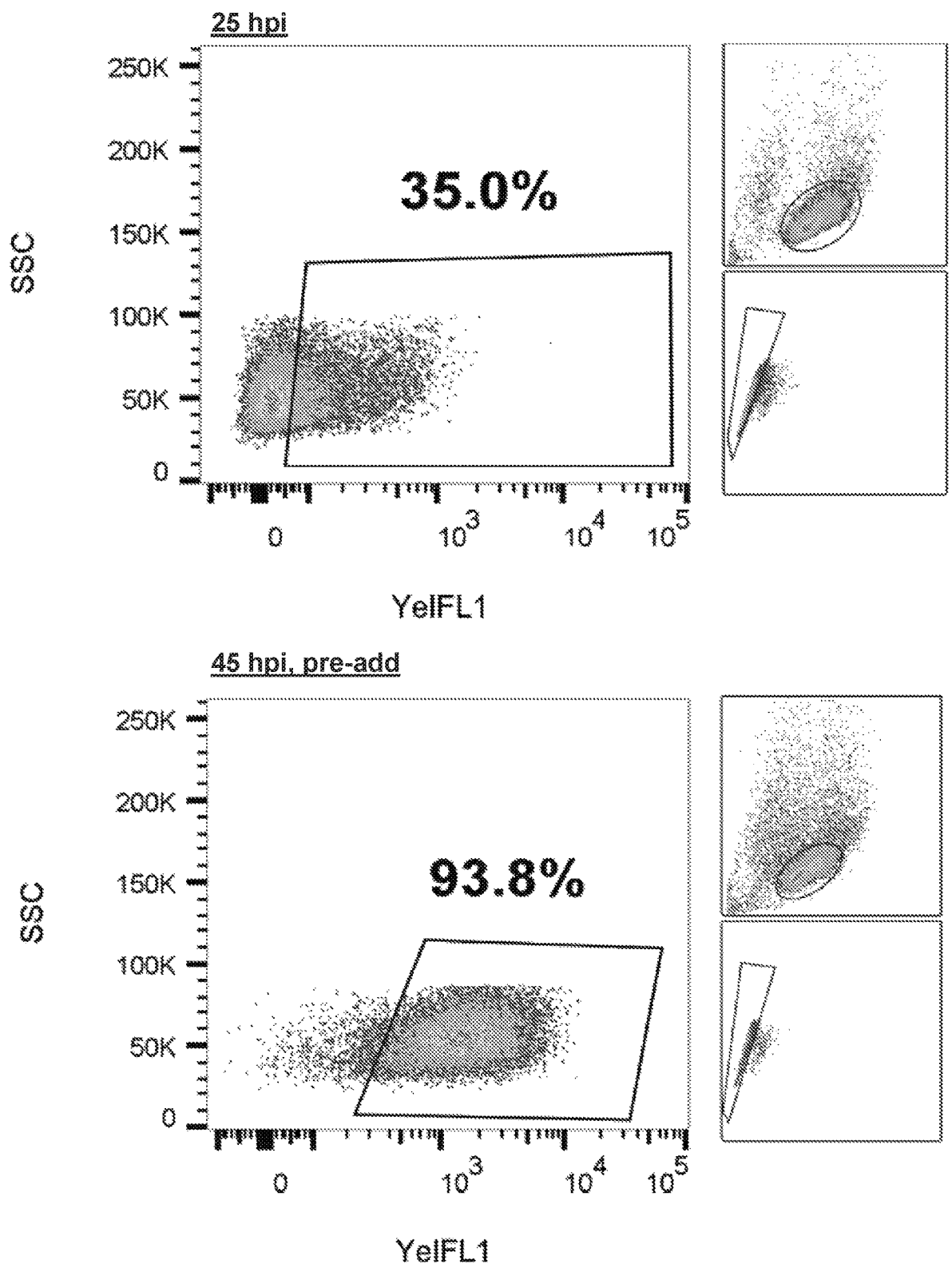

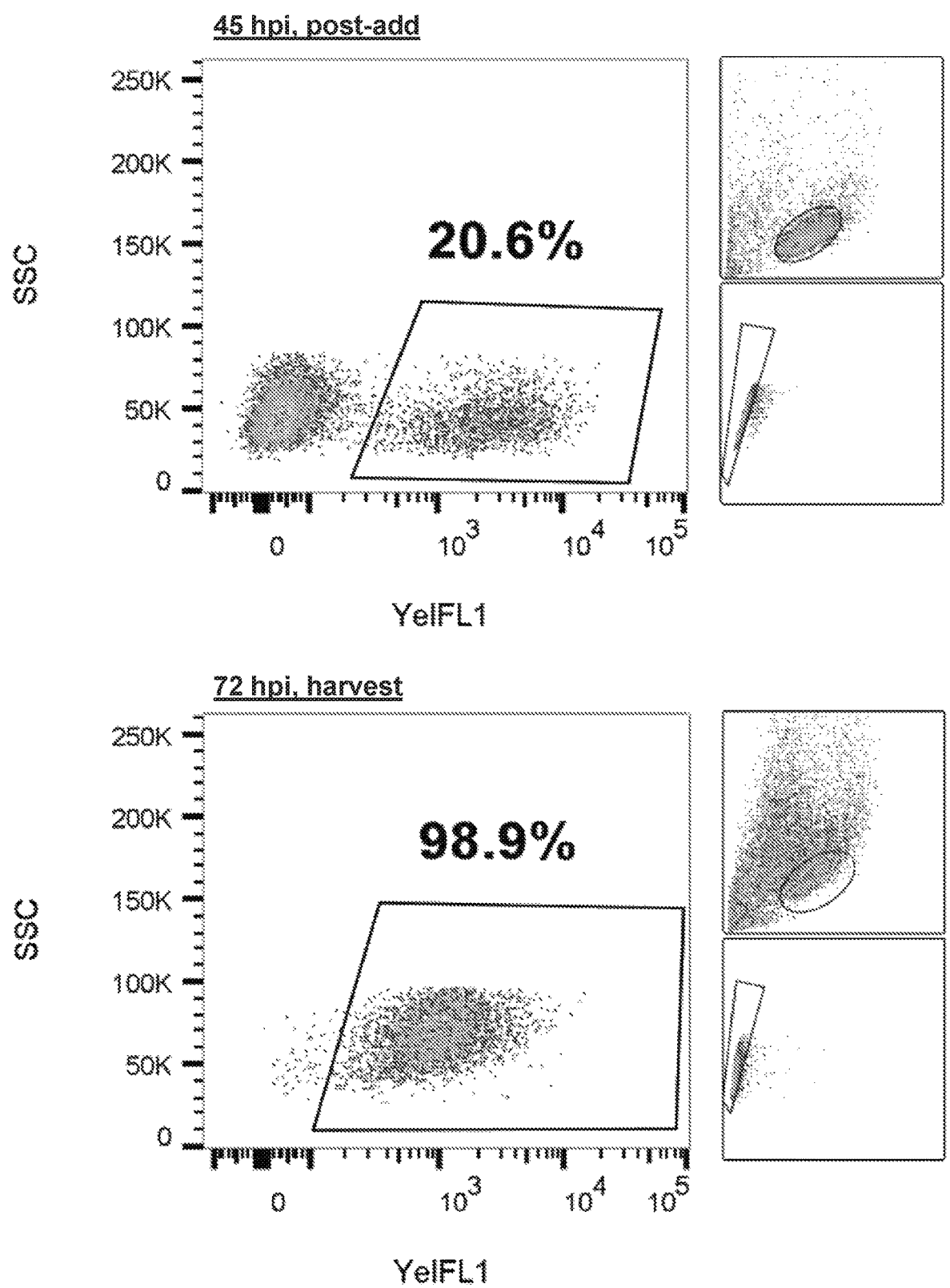
Figure 27 (Cont. 4) Flask K, NL4-3 + del. Lib.

Figure 29 (Cont.)
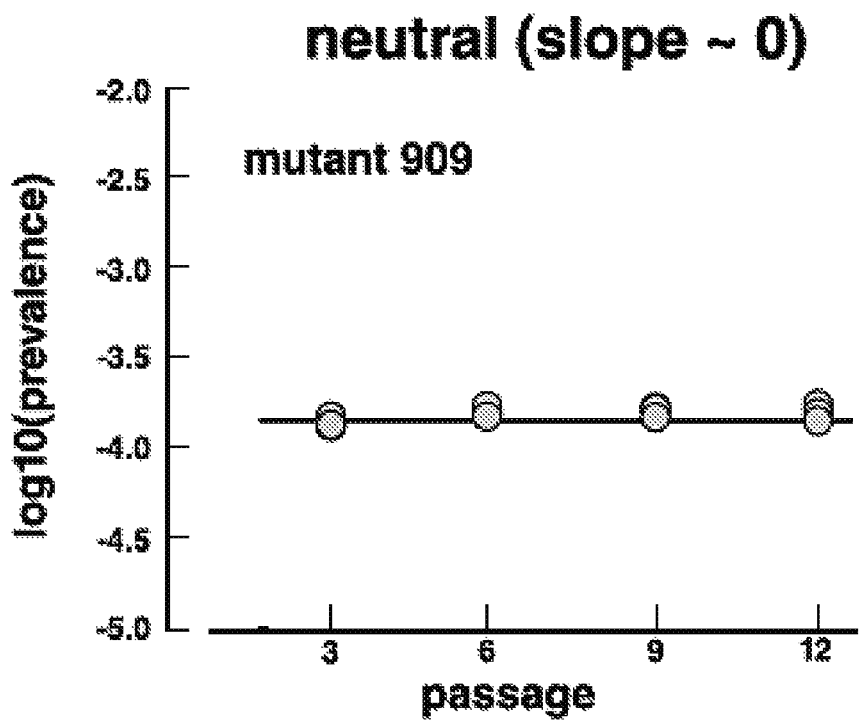
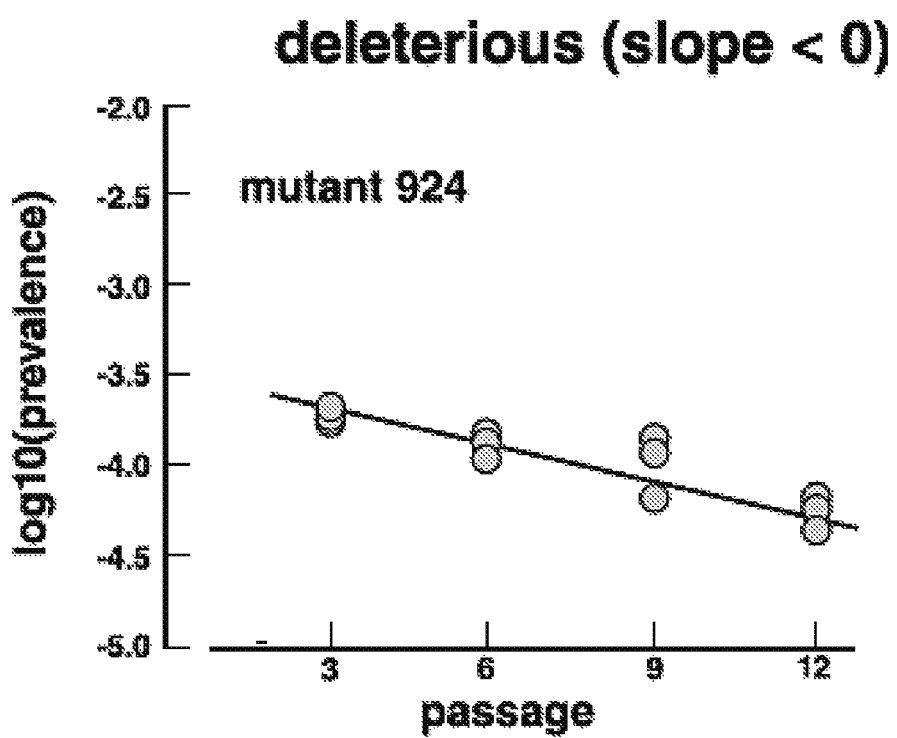

Figure 40

| mutant | Δ (bp) | Δ span left | Δ span right | barcode | enrich. (K/L/M)× | genes fully or partially deleted |
|---|---|---|---|---|---|---|
| NL43.B01 | 1016 | 1636 | 2651 | TTGAACCCATGGCCCGGATCA | 17/21/19× | *gag/pol* |
| NL43.B02 | 1361 | 1455 | 2815 | TGGACCCGCCCGGACGCTCA | 10/16/20× | *gag/pol* |
| NL43.B03 | 1547 | 1448 | 2994 | CAGGCAGCTCAAGAAACACG | 4/12/21× | *gag/pol* |
| NL43.B04 | 908 | 1469 | 2376 | TCGACAGTGTAATGTCTGCA | 27/16/19× | *gag/pol* |
| NL43.B05 | 825 | 1484 | 2308 | GGGGGGGCGGGCATTACTTGT | 20/39/7× | *gag/pol* |
| NL43.B06 | 860 | 1469 | 2328 | GAGCTGCAGGGCATGTTATA | 23/20/32× | *gag/pol* |
| NL43.B07 | 796 | 1560 | 2355 | GGCGACCCTCGGCCGTGGAC | 26/16/16× | *gag/pol* |
| NL43.C01 | 987 | 3620 | 4606 | CAGCTTGTTCAGATGCTGTA | 30/36/43× | *pol* |
| NL43.D01 | 986 | 5073 | 6058 | TCTTGAACAGCGCGGGTCTGT | 250/91/130× | *vif/vpr/tat/rev* |
| NL43.D02 | 986 | 5073 | 6058 | D01 but without barcode | NA | *vif/vpr/tat/rev* |
| NL43.D03 | 1089 | 5071 | 6159 | GATCGGTCGTCGCAGCGGTC | 50/36/23× | *vif/vpr/tat/rev/vpu* |
| NL43.D04 | 1211 | 5041 | 6251 | TATCTGTAGCCAACATTCGA | 18/18/9× | *vif/vpr/tat/rev/vpu/env* |
| NL43.F01 | 174 | 9116 | 9289 | CGTAAAGTGGGATAGTTTTT | 17/17/14× | *nef/U3* |

Figure 49 (Cont.)

Others

Table 9

|  |  | shaded/italicized are not rep. comp. (within gray rectangle) | shaded/italicized are interfering (below gray rectangle) | shaded/italicized are interfering (below gray rectangle) |
|---|---|---|---|---|
|  |  | Figure 43 | Figure 45 | Figure 48 |
|  |  | PrestoBlue,-DRV | GFP,24h,-DRV | GFP,48h,-DRV |
| (left) | 1 | hiv00 | *hiv54* | *hiv54* |
|  | 2 | hiv01 | *hiv11* | *hiv58* |
|  | 3 | *hiv09* | *hiv58* | *hiv44* |
|  | 4 | *hiv19* | *hiv47* | *hiv47* |
|  | 5 | *hiv02* | *hiv44* | *hiv55* |
|  | 6 | *hiv16* | *hiv60* | *hiv31* |
|  | 7 | *hiv52* | *hiv49* | *hiv11* |
|  | 8 | *hiv17* | *hiv42* | *hiv60* |
|  | 9 | *hiv13* | *hiv55* | *hiv42* |
|  | 10 | *hiv14* | *hiv10* | *hiv21* |
|  | 11 | *hiv18* | *hiv28* | *hiv28* |
|  | 12 | *hiv09* | *hiv31* | *hiv49* |
|  | 13 | *hiv16* | *hiv15* | *hiv37* |
|  | 14 | *hiv04* | *hiv21* | *hiv27* |
|  | 15 | *hiv11* | *hiv27* | *hiv23* |
|  | 16 | *hiv06* | *hiv14* | *hiv56* |
|  | 17 | *hiv15* | *hiv23* | *hiv48* |
|  | 18 | *hiv08* | *hiv37* | *hiv24* |
|  | 19 | *hiv10* | *hiv10* | *hiv32* |
|  | 20 | *hiv17* | *hiv48* | *hiv45* |
|  | 21 | *hiv14* | *hiv56* | *hiv14* |
|  | 22 | *hiv37* | *hiv24* | *hiv10* |
|  | 23 | *hiv20* | *hiv14* | *hiv30* |
|  | 24 | *hiv18* | *hiv45* | *hiv15* |
|  | 25 | *hiv35* | *hiv32* | *hiv10* |
|  | 26 | *hiv09* | *hiv52* | *hiv36* |
|  | 27 | *hiv03* | *hiv33* | *hiv52* |
|  | 28 | *hiv07* | *hiv30* | *hiv25* |
|  | 29 | *hiv35* | *hiv59* | *hiv14* |
|  | 30 | *hiv36* | *hiv36* | *hiv59* |
|  | 31 | *hiv37* | *hiv13* | *hiv36* |
|  | 32 | *hiv25* | *hiv36* | *hiv23* |

Figure 50

| | | Table 9 (Cont.) | | |
|---|---|---|---|---|
| | 33 | *hiv23* | *hiv23* | *hiv33* |
| | 34 | *hiv32* | *hiv22* | *hiv46* |
| | 35 | *hiv36* | *hiv46* | *hiv35* |
| | 36 | *hiv51* | *hiv25* | *hiv37* |
| | 37 | *hiv53* | *hiv37* | *hiv25* |
| | 38 | *hiv05* | *hiv12* | *hiv22* |
| | 39 | *hiv60* | *hiv34* | *hiv13* |
| | 40 | *hiv10* | *hiv25* | *hiv32* |
| | 41 | *hiv39* | *hiv57* | *hiv43* |
| | 42 | *hiv32* | *hiv16* | *hiv52* |
| | 43 | *hiv12* | *hiv18* | *hiv35* |
| | 44 | *hiv41* | *hiv35* | *hiv50* |
| | 45 | *hiv59* | *hiv32* | *hiv40* |
| | 46 | *hiv54* | *hiv50* | *hiv34* |
| | 47 | *hiv57* | *hiv43* | *hiv12* |
| | 48 | *hiv46* | *hiv16* | *hiv57* |
| | 49 | *hiv23* | *hiv18* | *hiv39* |
| | 50 | *hiv56* | *hiv39* | *hiv18* |
| | 51 | *hiv19* | *hiv40* | *hiv16* |
| | 52 | *hiv58* | *hiv19* | *hiv41* |
| | 53 | *hiv42* | *hiv19* | *hiv18* |
| | 54 | *hiv45* | *hiv35* | *hiv16* |
| | 55 | *hiv48* | *hiv17* | *hiv20* |
| | 56 | *hiv55* | *hiv52* | *hiv19* |
| | 57 | *hiv47* | *hiv20* | hiv01 |
| | 58 | *hiv40* | *hiv41* | hiv53 |
| | 59 | *hiv43* | *hiv17* | hiv19 |
| | 60 | *hiv22* | *hiv53* | hiv38 |
| | 61 | *hiv38* | *hiv51* | hiv51 |
| | 62 | *hiv30* | hiv38 | hiv29 |
| | 63 | *hiv44* | hiv29 | hiv05 |
| | 64 | *hiv29* | hiv01 | hiv04 |
| | 65 | *hiv26* | hiv26 | hiv26 |
| | 66 | *hiv50* | hiv00 | hiv17 |
| | 67 | *hiv25* | hiv04 | hiv00 |
| | 68 | *hiv52* | hiv05 | hiv17 |
| | 69 | *hiv24* | hiv09 | hiv09 |

Figure 50 (Cont.)

| Table 9 (Cont.) | | | | |
|---|---|---|---|---|
| | 70 | *hiv31* | hiv09 | hiv08 |
| | 71 | *hiv27* | hiv09 | hiv06 |
| | 72 | *hiv28* | hiv08 | hiv09 |
| | 73 | *hiv33* | hiv06 | hiv03 |
| | 74 | *hiv49* | hiv07 | hiv09 |
| | 75 | *hiv21* | hiv03 | hiv02 |
| (right) | 76 | *hiv34* | hiv02 | hiv07 |

METHODS AND COMPOSITIONS FOR GENERATING A DELETION LIBRARY AND FOR IDENTIFYING A DEFECTIVE INTERFERING PARTICLE (DIP)

STATEMENT REGARDING FEDERALLY SPONSORED RESEARCH

This invention was made with government support under Grant Nos. OD006677 and OD017181, awarded by the National Institutes of Health, and Grant No. D15AP00024, awarded by the Defense Advanced Research Projects Agency. The government has certain rights in the invention.

CROSS-REFERENCE

This application is a U.S. National Stage entry of International Application No. PCT/US2017/066462, which claims the benefit of U.S. Provisional Patent Application No. 62/434,322, filed Dec. 14, 2016, the disclosures of which applications are incorporated herein by reference in their entirety.

INCORPORATION BY REFERENCE OF SEQUENCE LISTING PROVIDED AS A TEXT FILE

A Sequence Listing is provided herewith as a text file, "2262557.txt" created on Aug. 16, 2022 and having a size of 695,986 bytes. The contents of the text file are incorporated by reference herein in their entirety.

INTRODUCTION

Circular DNAs, e.g., plasmids, have become a ubiquitous tool in molecular biology. There is a need in the art for additional methods and compositions for manipulating circular target DNAs for a variety of purposes. For example, there is a need for methods and compositions that facilitate the generation of deletion libraries (e.g., libraries of circular DNAs in which members of the library include one or more deletions at different locations relative to other members of the library).

SUMMARY

Provided are methods and compositions for generating a deletion library. In some embodiments, a subject method includes: (a) inserting a transposon cassette comprising a target sequence for a sequence specific DNA endonuclease into a population of circular target DNAs to generate a population of transposon-inserted circular target DNAs; (b) contacting the population of transposon-inserted circular target DNAs with the sequence specific DNA endonuclease to generate a population of cleaved linear target DNAs; (c) contacting the population of cleaved linear target DNAs with one or more exonucleases to generate a population of deletion DNAs; and (d) circularizing the deletion DNAs to generate a library of circularized deletion DNAs. In some cases, the transposon cassette includes a first recognition sequence positioned at or near one end of the transposon cassette and a second recognition sequence positioned at or near the other end of the transposon cassette.

In some embodiments, the circular target DNAs are plasmids that comprise a viral genome. In some such cases, the method further includes introducing members of the library of circularized deletion DNAs into mammalian cells, and assaying for viral infectivity. In some cases, the method further includes sequencing members of the library of circularized deletion DNAs to identify defective interfering particles (DIPs).

In some cases, the sequence specific DNA endonuclease is selected from: a meganuclease, a CRISPR/Cas endonuclease, a zinc finger nuclease, or a TALEN. In some cases, the one or more exonucleases includes T4 DNA polymerase. In some cases, the one or more exonucleases includes a 3' to 5' exonuclease and a 5' to 3' exonuclease. In some cases, the one or more exonucleases includes RecJ. In some cases, a subject method includes inserting a barcode sequence prior to or simultaneous with step (d). In some cases, the step of contacting the population of cleaved linear target DNAs with one or more exonucleases is performed in the presence of a single strand binding protein (SSB).

Also provided are methods of generating and identifying a defective interfering particle (DIP). In some cases, such a subject method includes (a) inserting a target sequence for a sequence specific DNA endonuclease into a population of circular target viral DNAs, each comprising a viral genome, to generate a population of sequence-inserted viral DNAs; (b) contacting the population of sequence-inserted viral DNAs with the sequence specific DNA endonuclease to generate a population of cleaved linear viral DNAs; (c) contacting the population of cleaved linear viral DNAs with an exonuclease to generate a population of deletion DNAs; (d) circularizing the deletion DNAs to generate a library of circularized deletion viral DNAs; and (e) sequencing members of the library of circularized deletion viral DNAs to identify deletion interfering particles (DIPs). In some cases, the method includes inserting a barcode sequence prior to or simultaneous with step (d).

In some cases, the method includes introducing members of the generated library of circularized deletion DNAs into cells, e.g., mammalian cells, and assaying for viral infectivity. In some cases, the inserting of step (a) includes inserting a transposon cassette into the population of circular target viral DNAs, where the transposon cassette includes the target sequence for the sequence specific DNA endonuclease, and wherein said generated population of sequence-inserted viral DNAs is a population of transposon-inserted viral DNAs. In some cases, the method includes, after step (d), infecting cells, e.g., mammalian cells in culture with members of the library of circularized deletion viral DNAs at a high multiplicity of infection (MOI), culturing the infected cells for a period of time ranging from 12 hours to 2 days, adding naive cells to the to the culture, and harvesting virus from the cells in culture. In some cases, the method includes, after step (d), infecting cells, e.g., mammalian cells in culture with members of the library of circularized deletion viral DNAs at a low multiplicity of infection (MOI), culturing the infected cells in the presence of an inhibitor of viral replication for a period of time ranging from 1 day to 6 days, infecting the cultured cells with functional virus at a high MOI, culturing the infected cells for a period of time ranging from 12 hours to 4 days, and harvesting virus from the cultured cells.

Also provided are transposon cassettes, which may be utilized, for example, in the methods described herein. In some embodiments a subject transposon cassette is a DNA molecule that includes transposase compatible inverted terminal repeats (ITRs) flanking a sequence of interest, wherein the sequence of interest includes a first copy and a second copy of a recognition sequence for a first meganuclease. In some cases the transposase compatible inverted terminal repeats (ITRs) are cable of being recognized and utilized by a Tn5 transposase. In some cases the sequence of interest includes a selectable marker gene, and the first and second copies flank the selectable marker gene. In some cases the selectable marker gene encodes an antibiotic resistance protein. In some cases the transposon cassette includes a first copy and a second copy of a recognition sequence for a second meganuclease. In some cases the first and second copies of the recognition sequence for the second meganuclease flank a selectable marker gene. In some cases the transposase compatible inverted terminal repeats (ITRs) are cable of being recognized and utilized by a Tn5 transposase.

Also provided are human immunodeficiency virus (HIV) deletion mutants, e.g., interfering, conditionally replicating, HIV deletion mutants, and related constructs identified using the screening methods described herein.

BRIEF DESCRIPTION OF THE DRAWINGS

The invention is best understood from the following detailed description when read in conjunction with the accompanying drawings. It is emphasized that, according to common practice, the various features of the drawings are not to-scale. On the contrary, the dimensions of the various features are arbitrarily expanded or reduced for clarity. Included in the drawings are the following figures.

FIG. 11 provides a histogram of deletion sizes of an HIV-1 deletion library (pNL4-3Δ$_1$) which was generated using methods described herein. The histogram shows a diverse range of different sized deletions. Data were obtained by deep-sequencing the deletion plasmid library.

FIG. 12 provides a plot of deletion depth vs genome location for the same library referred to in FIG. 11. The plot demonstrates that the deletion library was comprehensive (coverage over the genome) and relatively unbiased. The valley surrounding ori/bla (required for plasmid maintenance in culture) shows that bacteria harboring plasmids with deletions in this region were select against.

FIG. 20 provides sequences for constructs used in the examples section. Note: "TN5MK" is referred to as "MOD2*-Kan$^R$" in FIG. 3 and FIG. 4, and "TN5MC" is referred to as "MOD2*-Cm$^R$" in FIG. 3.

FIG. 21 provides a table showing details of the pNL4-3Δ$_1$ deletion library of the present disclosure.

FIG. 39 provides a schematic of a block assembly strategy to generate multiply deleted strains according to an exemplary embodiment of the present disclosure. New HIV-1 mutants can be created by 7-insert Gibson Assemblies (top) or 3-insert assemblies, using previously assembled ABC and EFG blocks.

FIG. 40 provides a table showing reconstructed single contiguous deletions from pNL4-3$\Delta_1$ according to an exemplary embodiment of the present disclosure. For each deletion, the following information are provided: block name; size of deletion in bp; location of deletion in the NL4-3 provirus genome; barcode sequence in integrated barcode cassette (top to bottom: SEQ ID NOs.: 44-55); enrichment from plasmid library to passage 12 virus in replicate K, L, and M; which genes are potentially inactivated by truncation. For example: NL43_B01 represents a 1016 bp deletion in gag and pol (bases 1636-2651 of pNL4-3/NL4-3) and was enriched 17-fold in replicate K, 21-fold in replicate L, and 19-fold in replicate M after 12 rounds of passage in MT-4.

FIG. 41 provides a graph and schematic illustrating reconstitution of adaptive single contiguous adaptive deletions of HIV-1 according to an exemplary embodiment of the present disclosure. Information is displayed in four horizontal tracks, with horizontal numbering in bp. From top to bottom: HIV-clonedDeletions mapping of adaptive HIV-1 deletions to proviral genome; HIV-genes location of HIV-1 genes; HIV-CAE Putative HIV-1-acting elements in the literature; pNL4-3, passage 12, deletion depth profile of the NL4-3$\Delta_1$ library after twelve high MOI passages.

FIG. 42 provides a graph showing that most deletion mutants are not replication-competent (sorted by genotype) according to an exemplary embodiment of the present disclosure. MT-4 cells were infected with viral inocula produced by transfection of 293T with cloned HIV-1 mutants, and evaluated for viability by PrestoBlue assay at 5 days post-infection. Each clone was assessed by two independent experiments (n=2). The shaded region represents viability (fluorescence) values within ±30% of the uninfected cell mean (naïve). The genotype of each mutant can be read off using the key and annotations in the plot. The only clones to exhibit consistent cell killing (replication) were the reconstructed wildtype (WT) and F01-only mutant (Δnef). The positive control (NL43G) exhibited expected cell-killing as well.

FIG. 43 provides a graph showing that most deletion mutants are not replication-competent (ranked by decreasing replication competence (cell killing)) according to an exemplary embodiment of the present disclosure. MT-4 cells were infected with viral inocula produced by transfection of 293T with cloned HIV-1 mutants, and evaluated for viability by PrestoBlue assay at 5 days post-infection. Each clone was assessed by two independent experiments (n=2). The shaded region represents viability (fluorescence) values within ±30% of the uninfected cell mean (naïve). The only clones to exhibit consistent cell killing (replication) were the reconstructed wildtype (WT) and F01-only mutant (Δnef). The positive control (NL43G) exhibited expected cell-killing as well.

FIG. 44 provides a graph showing that select deletion mutants interfere with wildtype HIV-1 replication (24 h, -Darunavir), ordered by genotype, according to an exemplary embodiment of the present disclosure. MT-4 cells were infected with viral inocula produced by transfection of 293T with cloned HIV-1 mutants and a replication competent, GFP-tagged virus (NL43G), then evaluated for wildtype infection (GFP fluorescent cells) 24 hours post infection (one round of replication). Each clone was assessed by two independent experiments (n=2): both points are plotted above in a single column. The shaded region represents GFP+ values within ±30% of the mean of the NL43G only control. Clones with values below this region interfere with wildtype viral replication, clones with values above enhance wildtype virus replication. Uninfected cells (naïve) have a background GFP+ value of ≈1%. The genotype of each mutant can be read off using the key and annotations in the plot. Replication-competent clones (annotated as WT and Δnef) did not interfere with wildtype replication.

FIG. 45 provides a graph showing that select deletion mutants interfere with wildtype HIV-1 replication (24 h, -Darunavir), ranked by decreasing ability to interfere with WT virus replication, according to an exemplary embodiment of the present disclosure. FIG. 45 provides the same data as FIG. 44 but ranked by increasing interference effect. MT-4 cells were infected with viral inocula produced by transfection of 293T with cloned HIV-1 mutants and a replication competent, GFP-tagged virus (NL43G), then evaluated for wildtype infection (GFP fluorescent cells) 24 hours post infection (one round of replication). Each clone was assessed by two independent experiments (n=2): both points are plotted above in a single column. The shaded region represents GFP+ values within ±30% of the mean of the NL43G only control. Clones with values below this region interfere with wildtype viral replication, clones with values above enhance wildtype virus replication. Uninfected cells (naïve) have a background GFP+ value of ≈1%. Replication-competent clones (annotated as WT and Δnef) did not interfere with wildtype replication.

FIG. 46 provides a graph showing that select deletion mutants interfere with wildtype HIV-1 replication (24 h, -Darunavir), ordered by genotype, according to an exemplary embodiment of the present disclosure. MT-4 cells were infected with viral inocula produced by transfection of 293T with cloned HIV-1 mutants and a replication competent, GFP-tagged virus (NL43G), then evaluated for wildtype infection (GFP fluorescent cells) 24 hours post infection (one round of replication). MT-4 cells were cultured in the presence of 500 nM Darunavir, an HIV-1 protease inhibitor, to restrict subsequent transmission post-infection. Each clone was assessed by two independent experiments (n=2): both points are plotted above in a single column. The shaded region represents GFP+ values within ±30% of the mean of the NL43G only control. Clones with values below this region interfere with wildtype viral replication, clones with values above enhance wildtype virus replication. Uninfected cells (naïve) have a background GFP+ value of ≈1%. The genotype of each mutant can be read off using the key and annotations in the plot. Replication-competent clones (annotated as WT and Δnef) did not interfere with wildtype replication.

FIG. 47 provides a graph showing that select deletion mutants interfere with wildtype HIV-1 replication (48 h, -Darunavir), ordered by genotype, according to an exemplary embodiment of the present disclosure. MT-4 were infected with viral inocula produced by transfection of 293T with cloned HIV-1 mutants and a replication competent, GFP-tagged virus (NL43G), then evaluated for wildtype infection (GFP fluorescent cells) 24 hours post infection (one round of replication). Each clone was assessed by two independent experiments (n=2): both points are plotted above in a single column. The shaded region represents GFP+ values within ±30% of the mean of the NL43G only control. Clones with values below this region interfere with wildtype viral replication, clones with values above enhance wildtype virus replication. Uninfected cells (naïve) have a background GFP+ value of ≈1%. The genotype of each mutant can be read off using the key and annotations in the plot. Replication-competent clones (annotated as WT and Δnef) did not interfere with wildtype replication.

Figure 47:
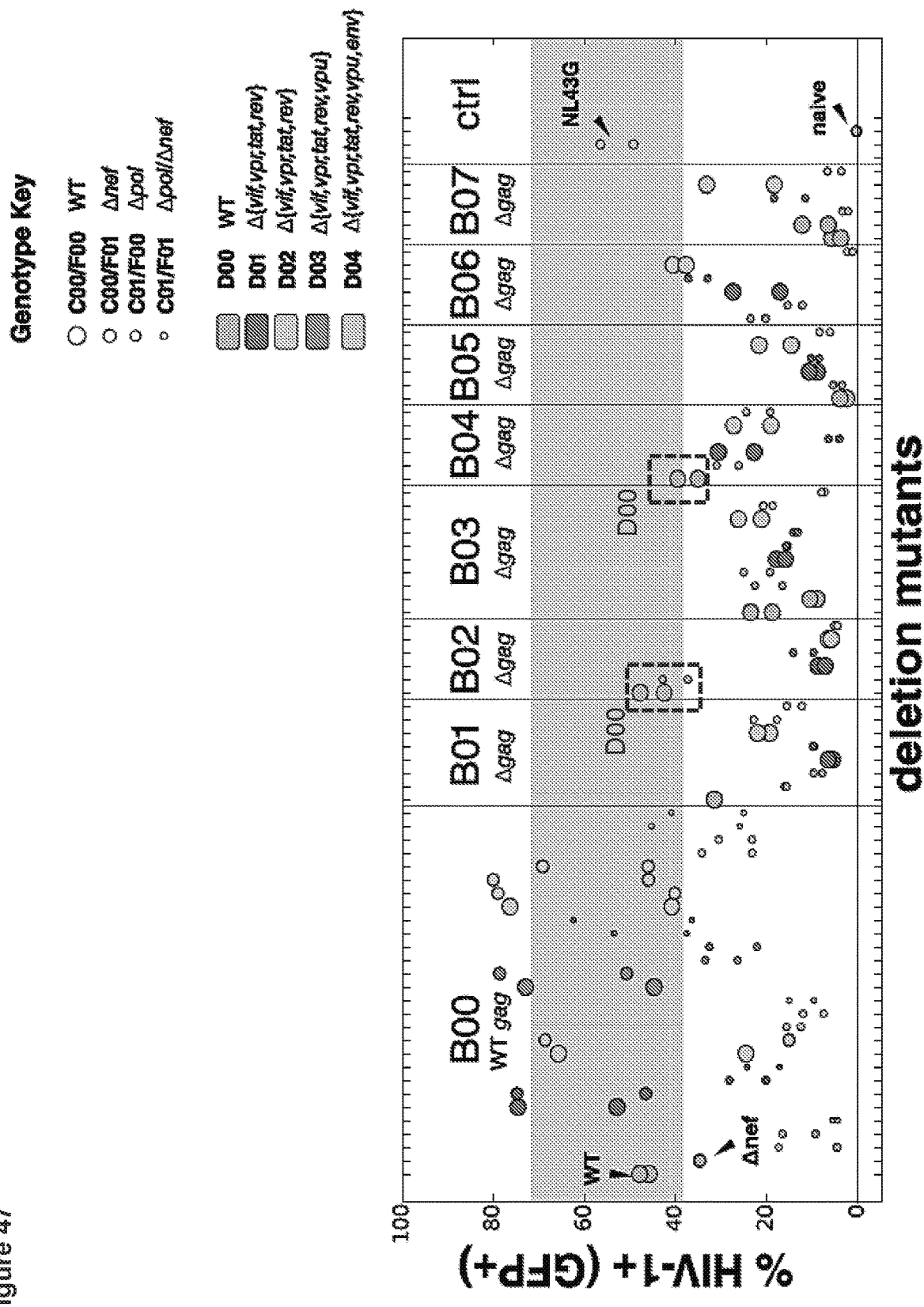
Figure 48:
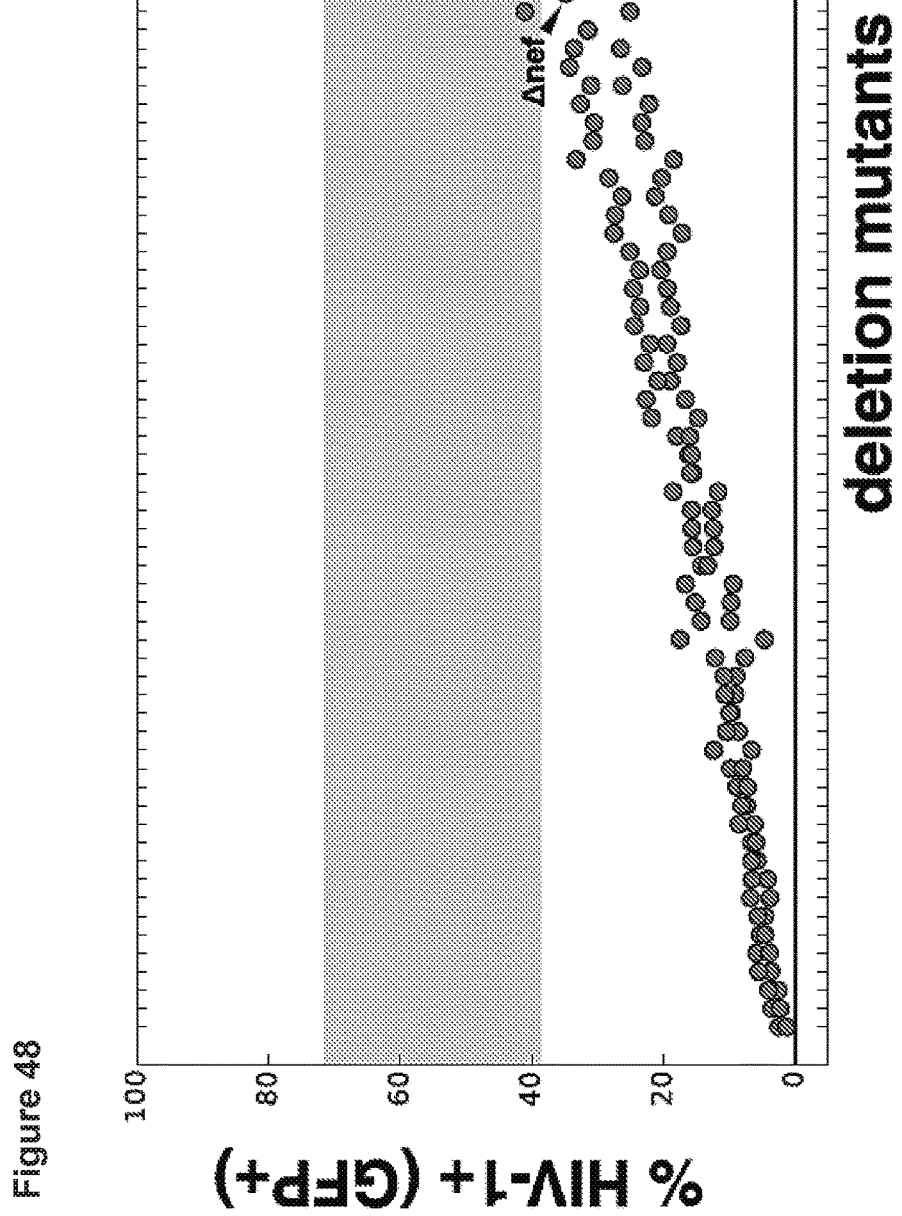

FIG. 48 provides a graph showing that select deletion mutants interfere with wildtype HIV-1 replication (48 h, -Darunavir), ranked by decreasing ability to interfere with WT virus replication, according to an exemplary embodiment of the present disclosure. FIG. 48 provides the same data as FIG. 47 but ranked by increasing interference effect. MT-4 cells were infected with viral inocula produced by transfection of 293T with cloned HIV-1 mutants and a replication competent, GFP-tagged virus (NL43G), then evaluated for wildtype infection (GFP fluorescent cells) 24 hours post infection (one round of replication). Each clone was assessed by two independent experiments (n=2): both points are plotted above in a single column. The shaded region represents GFP+ values within ±30% of the mean of the NL43G only control. Clones with values below this region interfere with wildtype viral replication, clones with values above enhance wildtype virus replication. Uninfected cells (naïve) have a background GFP+ value of ≈1%. Replication-competent clones (annotated as WT and Δnef) did not interfere with wildtype replication.

Figure 49:
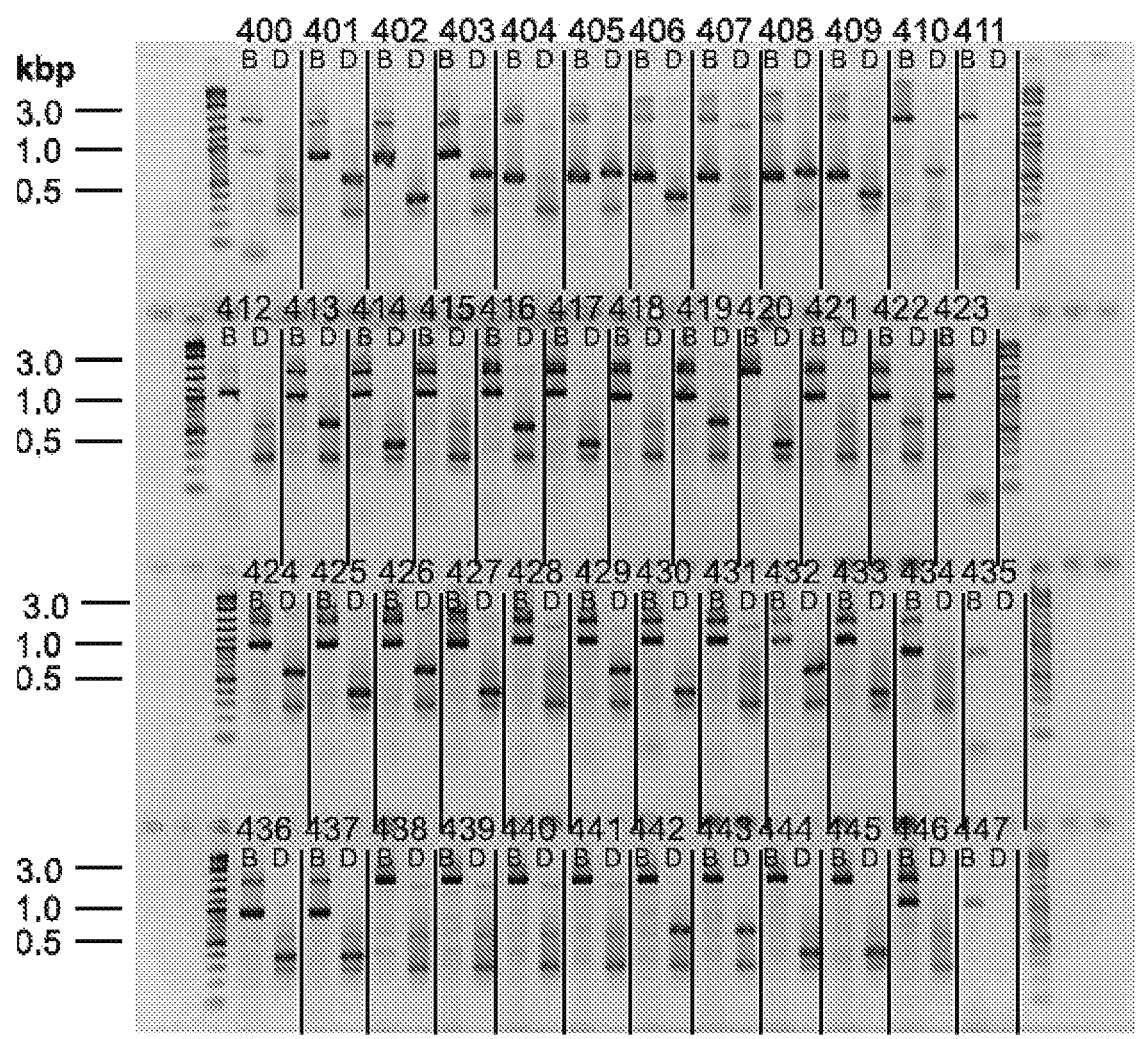

FIG. 49 provides gel images indicating that deletion mutants can be mobilized by providing missing common goods in trans according to an exemplary embodiment of the present disclosure. Deletion mutant pseudovirus stocks were prepared by packaging HIV-1 mutants in 293T by co-transfection with a VSV-G envelope plasmid and pCMVRΔ8.91, which provides four HIV-1 proteins (Gag, Pol, Tat, Rev). After 5 days of recovery in the presence of 500 nM Darunavir (an HIV-1 protease inhibitor), PCR for blocks B and D was performed on DNA isolated from the transduced cells. Each pair of lanes is marked with the BTN strain number in Table 5 (e.g. 427 is BTN427, 405 is BTN405), where B corresponds to the block B amplicon and D to the block D amplicon. The wildtype (undeleted) block B amplicon is 1.9 kbp and the WT block D amplicon is 1.5 kbp. A distinct, heavy band at size less than the WT amplicon indicates that the deletion mutant had been successfully mobilized and did not kill transduced cells. Control abbreviations are WT (infected with NL43G only), mk (mock-transfection, no deletion mutant genome was added to transfection), NTC (no template control, PCR with water as template).

Figure 43:
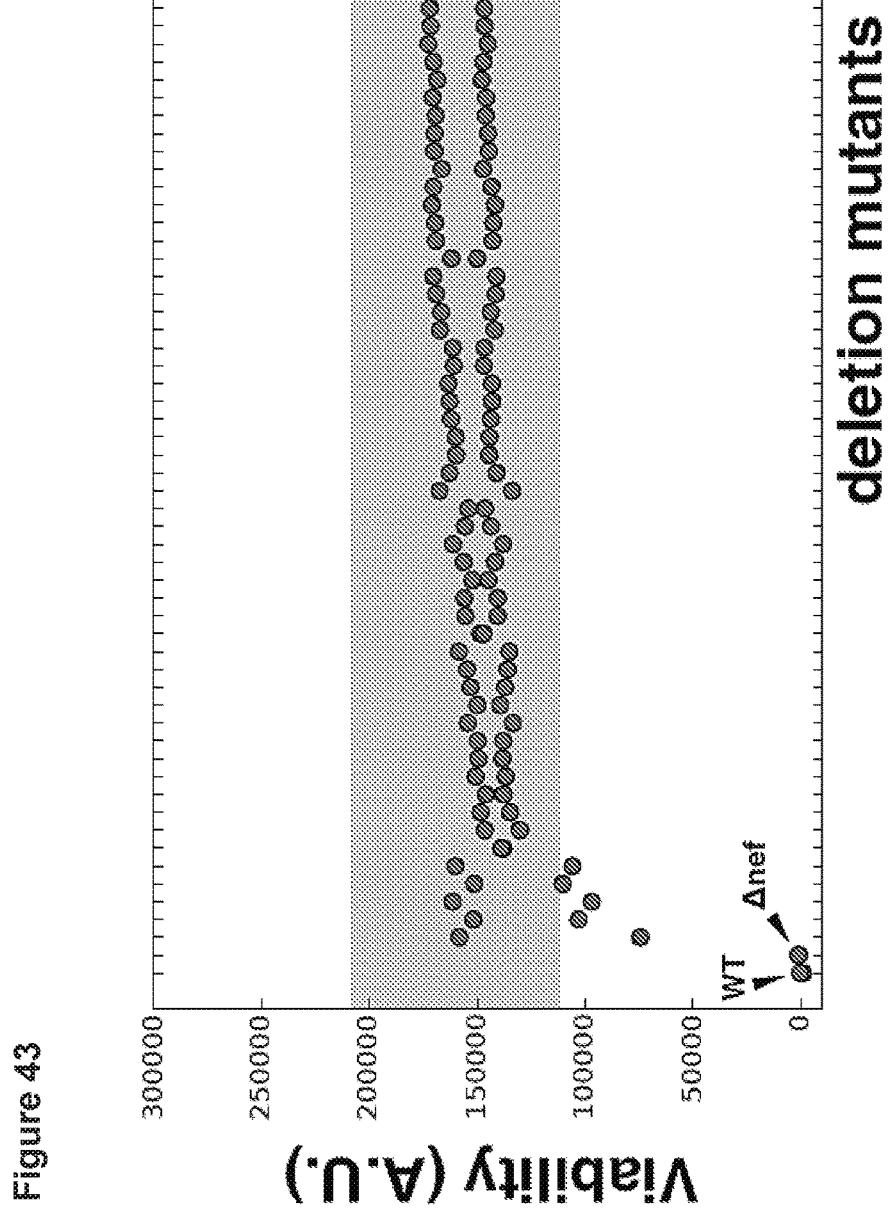
Figure 44:
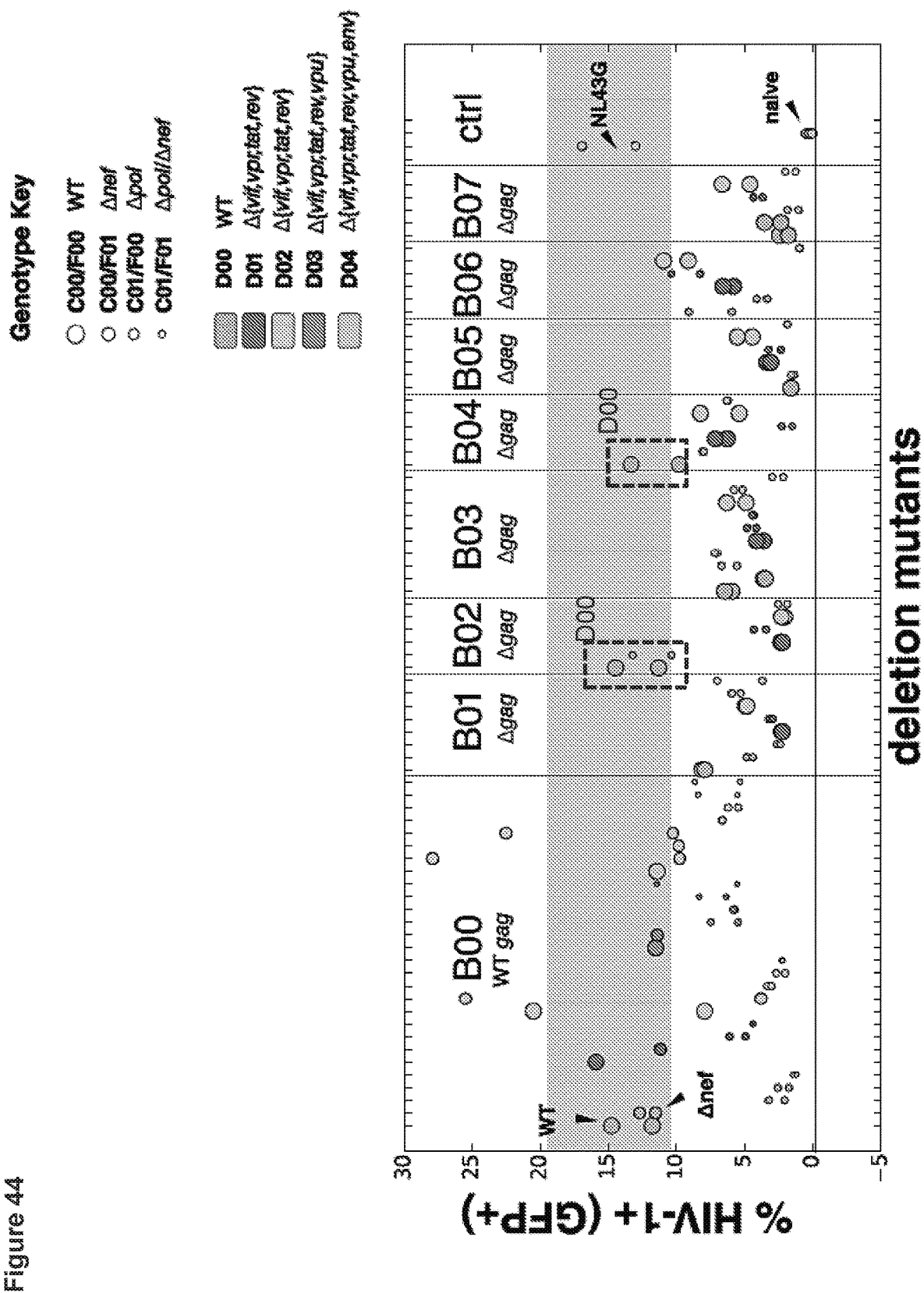
Figure 45:
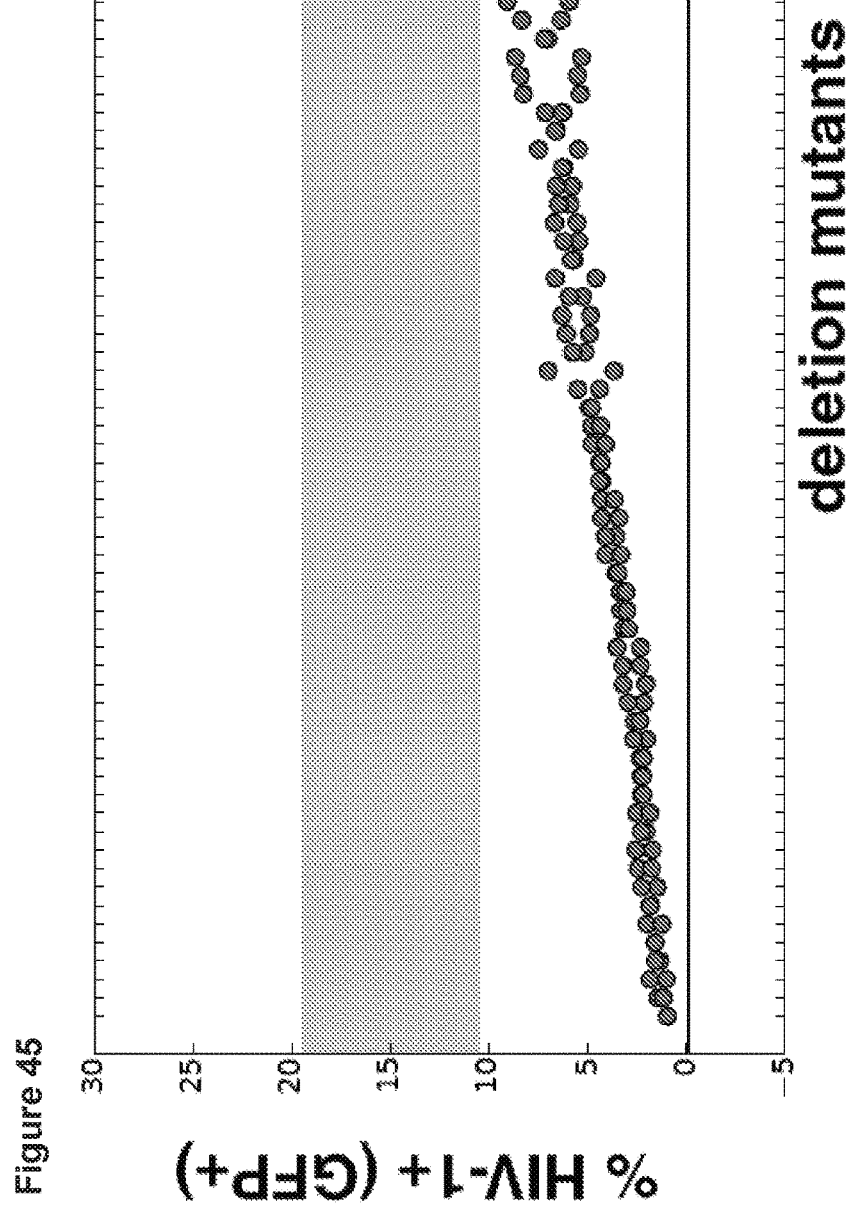
Figure 46:
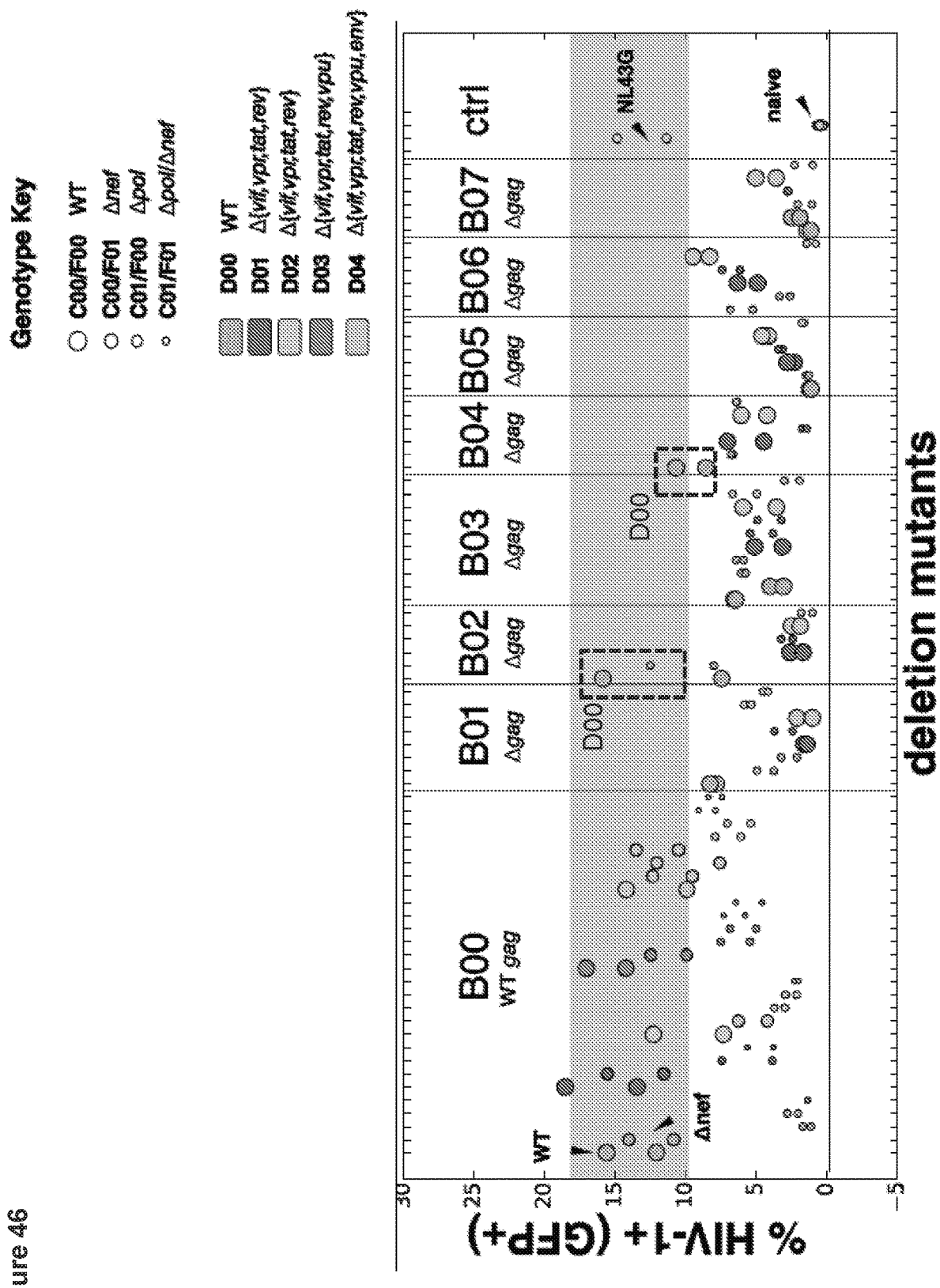

FIG. 50 shows Table 9, which serves as map between the data in FIGS. 43, 45, 48 and the sequence associated with each pair of 76 datapoints.

DETAILED DESCRIPTION

As summarized above, methods and compositions for generating a deletion library, and methods and compositions for generating and identifying a defective interfering particle (DIP) are provided. Also provided are transposon cassettes, which may be utilized, for example, in the methods described herein. In addition, the present disclosure provides human immunodeficiency virus (HIV) deletion mutants, e.g., interfering, conditionally replicating, HIV deletion mutants, and related constructs identified using the screening methods described herein.

Before the present methods and compositions are described, it is to be understood that this invention is not limited to the particular methods or compositions described, as such may, of course, vary. It is also to be understood that the terminology used herein is for the purpose of describing particular embodiments only, and is not intended to be limiting, since the scope of the present invention will be limited only by the appended claims.

Where a range of values is provided, it is understood that each intervening value, to the tenth of the unit of the lower limit unless the context clearly dictates otherwise, between the upper and lower limits of that range is also specifically disclosed. Each smaller range between any stated value or intervening value in a stated range and any other stated or intervening value in that stated range is encompassed within the invention. The upper and lower limits of these smaller ranges may independently be included or excluded in the range, and each range where either, neither or both limits are included in the smaller ranges is also encompassed within the invention, subject to any specifically excluded limit in the stated range. Where the stated range includes one or both of the limits, ranges excluding either or both of those included limits are also included in the invention.

Unless defined otherwise, all technical and scientific terms used herein have the same meaning as commonly understood by one of ordinary skill in the art to which this invention belongs. Although any methods and materials similar or equivalent to those described herein can be used in the practice or testing of the present invention, some potential and preferred methods and materials are now described. All publications mentioned herein are incorporated herein by reference to disclose and describe the methods and/or materials in connection with which the publications are cited. It is understood that the present disclosure supersedes any disclosure of an incorporated publication to the extent there is a contradiction. The complete disclosure of U.S. Patent Application Publication No. 2016-0015759 is incorporated by reference herein.

As will be apparent to those of skill in the art upon reading this disclosure, each of the individual embodiments described and illustrated herein has discrete components and features which may be readily separated from or combined with the features of any of the other several embodiments without departing from the scope or spirit of the present invention. Any recited method can be carried out in the order of events recited or in any other order that is logically possible.

It must be noted that as used herein and in the appended claims, the singular forms "a", "an", and "the" include plural referents unless the context clearly dictates otherwise. Thus, for example, reference to "a cell" includes a plurality of such cells and reference to "the endonuclease" includes reference to one or more endonucleases and equivalents thereof, known to those skilled in the art, and so forth. It is further noted that the claims may be drafted to exclude any element, e.g., any optional element. As such, this statement is intended to serve as antecedent basis for use of such exclusive terminology as "solely," "only" and the like in connection with the recitation of claim elements, or use of a "negative" limitation.

The publications discussed herein are provided solely for their disclosure prior to the filing date of the present application. Nothing herein is to be construed as an admission that the present invention is not entitled to antedate such publication. Further, the dates of publication provided may be different from the actual publication dates which may need to be independently confirmed.

Methods and Compositions

Provided are methods of generating a deletion library. Generally, members of a circular target DNA population are cleaved at different positions relative to one another to generate a library of cleaved (linearized) target DNAs where members of the library are cut at different locations. One or more exonucleases are then used to 'chew back' the end(s) of the cut site and the 'chewed ends' are then ligated to reform circular DNA. This generates a deletion library. There are numerous ways to achieve each of the steps (e.g., the cleavage step at different positions for the members of the library), and there are optional steps that can be performed prior to the circularizing (e.g., ligation) step. As discussed in more detail below, more than one round of library generation can be performed, and thus the subject methods can be used the generate complex deletion libraries in which members of the library include more than one deletion.

Generating a Library of Cleaved (Linearized) Target DNAs

Provided are methods that include generating a library of cleaved (linearized) target DNAs from a population of circular target DNAs. In some cases, the position of cleavage of the target DNA population is random. For example, a transposon cassette can be inserted at random positions into a population of target DNAs, where the transposon cassette includes a target sequence (recognition sequence) for a sequence specific DNA endonuclease. In such a case, the transposon cassette is being used as a vehicle for inserting a recognition sequence into the population of target DNAs (at random positions). A sequence specific DNA endonuclease (one that recognizes the recognition sequence) can then be used to cleave the target DNAs, thereby generating a library of cleaved (linearized) target DNAs where members of the library are cut at different locations.

The term "transposon cassette" is used herein to mean a nucleic acid molecule that includes a 'sequence of interest' flanked by sequences that can be used by a transposon to insert the sequence of interest into a target DNA. Thus, in some cases, the 'sequence of interest' is flanked by transposon compatible inverted terminal repeats (ITRs), i.e., ITRs that are recognized and utilized by a transposon. In cases where a transposon cassette is used as a vehicle for inserting one or more target sequences (for one or more sequence specific DNA endonucleases) into target DNAs, the sequence of interest can include the one or more recognition sequences.

In some cases, the sequence of interest includes a selectable marker gene, e.g., a nucleotide sequence encoding a selectable marker such as a gene encoding a protein that provides for drug resistance, e.g., antibiotic resistance. In some cases, a sequence of interest includes a first copy and a second copy of a recognition sequence for a first sequence specific DNA endonuclease (e.g., a first meganuclease). In some cases, a sequence of interest includes a selectable marker gene flanked by a first and second recognition sequence for a sequence specific DNA endonuclease (e.g., meganuclease). In some such cases, the first recognition sequence and the second recognition sequence are identical, and can be considered a first copy and a second copy of a recognition sequence. In some such cases, the first recognition sequence is different than the second recognition sequence. In some cases, the first recognition sequence and second recognition sequence (e.g., first and second copies of a recognition sequence) flank a selectable marker gene, e.g., one that encodes a drug resistance protein such as an antibiotic resistance protein. In some embodiments, a subject transposon cassette includes a first copy and a second copy of a recognition sequence for a first meganuclease; and a first copy and a second copy of a recognition sequence for a second meganuclease. In any of the above scenarios, in some cases, the first and/or second recognition sequence is a site for I-SceI (e.g., aactataacggtcctaa^ggtagcgaa (SEQ ID NO: 1)). in some cases, the first and/or second recognition sequence is a site for I-CeuI (e.g., aactataacggtcctaa^ggtagcgaa (SEQ ID NO: 2)). In some cases, a first recognition sequence is a site for I-SceI and a second recognition sequence is a site for I-CeuI. In some cases a first and/or second recognition sequence is a recognition sequence for a meganuclease, e.g., selected from: a LAGLIDADG meganuclease (LMNs), I-SceI, I-CeuI, I-CreI, I-DmoI, I-ChuI, I-DirI, I-FlmuI, I-FlmuII, I-AniI, I-SceIV, I-CsmI, I-PanI, I-PanII, I-PanMI, I-SceII, I-PpoI, I-SceIII, I-LtrI, I-GpiI, I-GZeI, I-OnuI, I-HjeMI, I-MsoI, I-TevI, I-TevII, I-TevIII, PI-MleI, PI-MtuI, PI-PspI, PI-Tli I, PI-Tli II, and PI-SceV.

As noted above, a subject transposon cassette includes a sequence of interest flanked by transposase compatible inverted terminal repeats (ITRs). The ITRs can be compatible with any desired transposase, e.g., a bacterial transposase such as Tn3, Tn5, Tn7, Tn9, Tn10, Tn903, Tn1681, and the like; and eukaryotic transposases such as Tc1/mariner super family transposases, piggyBac superfamily transposases, hAT superfamily transposases, Sleeping Beauty, Frog Prince, Minos, Himar1, and the like. In some cases, the transposase compatible ITRs are compatible with (i.e., can be recognized and utilized by) a Tn5 transposase. Some of the methods provided in this disclosure include a step of inserting a transposase cassette into a target DNA. Such a step includes contacting the target DNA and the transposon cassette with a transposase. In some cases this contacting occurs inside of a cell such as a bacterial cell, and in some cases this contacting occurs in vitro outside of a cell. As the transposase compatible ITRs listed above are suitable for compositions and methods disclosed herein, so too are the transposases. As such, suitable transposases include but are not limited to bacterial transposases such as Tn3, Tn5, Tn7, Tn9, Tn10, Tn903, Tn1681, and the like; and eukaryotic transposases such as Tc1/mariner super family transposases, piggyBac superfamily transposases, hAT superfamily transposases, Sleeping Beauty, Frog Prince, Minos, Himar1, and the like. In some cases, the transposase is a Tn5 transposase.

In some embodiments, a subject method includes a step of inserting a target sequence (e.g., one or more target sequences) for a sequence specific DNA endonuclease (e.g., one or more sequence specific DNA endonucleases) into a population of circular target DNAs, thereby generating a population of sequence-inserted circular target DNAs. In some cases, the inserting step is carried out by inserting a transposon cassette that includes the target sequence (e.g., the one or more target sequences), thereby generating a population of transposon-inserted circular target DNAs. In some cases, the transposon cassette includes a single recognition sequence (e.g., in the middle or near one end of the transposon cassette) and can therefore be used to introduce a single recognition sequence into the population of target DNAs. In some cases, the transposon cassette includes more than one recognition sequences (e.g., a first and a second recognition sequence). In some such cases, the first and second recognition sequences are positioned at or near the ends of the transposon cassette (e.g., within 20 bases, 30 bases, 50 bases, 60 bases, 75 bases, or 100 bases of the end) such that cleavage of the first and second recognition sequences effectively removes the transposon cassette (or most of the transposon cassette) from the target DNA, while simultaneously generating a linearized target DNA, and therefore generating the desired library of cleaved (linearized) target DNAs where members of the library are cut at different locations.

In some cases when the transposon cassette include first and second recognition sequences, the first and second recognition sequences are the same, and are therefore first and second copies of a given recognition sequence. In some such cases, the same sequence specific DNA endonuclease (e.g., restriction enzyme, meganuclease, programmable genome editing nuclease) can then be used to cleave at both sites.

In some embodiments, the transposon cassette includes a first and a second recognition sequence where the first and second recognition sequences are not the same. In some such cases, a different sequence specific DNA endonuclease (e.g., restriction enzyme, meganuclease, programmable genome editing nuclease) is used to cleave the two sites (e.g., the library of transposon-inserted target DNAs can be contacted with two sequence specific DNA endonucleases). However, in some cases one sequence specific DNA endonuclease can still be used. For example, in some cases two different guide RNAs can be used with the same CRISPR/Cas protein. As another example, in some cases a given sequence specific DNA endonuclease can recognize both recognition sequences.

In some cases, the population of circular target DNAs (e.g., plasmids) are present inside of host cells (e.g., bacterial host cells such as *E. coli*) and the step of inserting a transposon cassette takes place inside of the host cell (e.g., by introducing a transposase and/or a nucleic acid encoding a transposase into the cell; by inducing expression of a transposase, e.g., where the host cell already includes a nucleic acid encoding the transposase; and the like). In some such cases, a subject method can include a selection/growth step in the host cell. For example, if the transposon cassette includes a drug resistance marker, the host cells can be grown in the presence of drug to select for those cells harboring a transposon-inserted circular target DNA.

Once a population of transposon-inserted circular target DNAs is generated (and in some cases after a selection/growth step in the host cells), they can be isolated/purified from the host cells prior to the next step (e.g., prior to contacting them with a sequence specific DNA endonuclease).

In some cases (e.g., when the circular target DNAs are small circular DNAs, e.g., less than 50 kb), a selection and growth step in bacteria can be avoided through the use of in vitro rolling circle amplification (RCA). For example, after repair of nicked target DNA post-transposition, a highly-processive and strand-displacing polymerase (e.g., phi29 DNA polymerase), along with primers specific to the inserted transposon cassette, can be used to selectively amplify insertion mutants from the pool of circular plasmids. In other words, such a step can circumvent amplifying DNA through bacterial transformation. Use of RCA can decrease the time required for growth/selection of bacteria and can avoid biasing the library towards clones that do not impede bacterial growth.

Non-Random Cleavage

As noted above, in some cases the position of cleavage of the target DNA population is random, however in some cases the position of cleavage is not random. For example, a population of target DNAs can be distributed (e.g., aliquoted) into different vessels (e.g., different tubes, different wells of a multi-well plate etc.). If a sequence of interest is known (e.g., a viral genome sequence), that is present in the population of target DNAs, then target DNAs in vessels (e.g., wells of the multi-well plate) can be cleaved at different pre-determined locations by using a programmable sequence specific endonuclease. For example, if a CRISPR/Cas endonuclease (e.g., Cas9, Cpf1, and the like) is used, guide RNAs can readily be designed to target any desired sequence within the target population (e.g., while taking protospacer adjacent motif (PAM) sequence requirements into account in some cases). For example, guide RNAs can be tiled at any desired spacing (e.g., every 5 nucleotides (nt), every 10 nt, every 20 nt, every 50 nt—overlapping, non-overlapping, and the like) along a sequence of interest, and the target DNAs in each vessel (e.g., each well) can be contacted with one of the guide RNAs in addition to the CRISPR/Cas endonuclease. In this way, a library of cleaved target DNAs can be generated where members of the library are separated from one another because they are in separate vessels. As would be understood by one of ordinary skill in the art, in some cases, one would take PAM sequences into account when designing guide RNAs, and therefore the spacing between guide RNA target sites can be a function of PAM sequence constraints, and consistent spacing across a given target sequence would not necessarily be possible in some cases. However, different CRISPR/Cas endonucleases (e.g., even the same protein, such as Cas9, isolated from different species) can have different PAM requirements, and thus, the use of more than one CRISPR/Cas endonuclease can in some cases relieve at least some of the constraints imposed by PAM requirements on available target sites.

The remaining steps can then be carried out separately (e.g., in separate vessels, in separate wells of a multi-well plate), or at any step, members can be pooled and treated together in one vessel. As an illustrative but non-limiting example, one could use 96 different guide RNAs (or 384 different guide RNAs) to cleave target DNAs in 96 different wells of a 96-well plate (or 384 different wells of a 384 well plate), to generate 96 members (or 384 members) of a library where each member is cleaved at a different site (and in this case the sites are designed by the user prior to starting the method). The exonuclease step (chew back) can then be performed in separate wells (e.g., by aliquoting exonuclease to each well), or wells can be pooled prior to adding exonuclease to the pool.

Circular Target DNAs

A circular target DNA of a population of circular target DNAs can be any circular target DNA. In some cases, the circular target DNAs are plasmid DNAs, e.g., in some cases, the circular target DNAs include an origin of replication (ORI). In some cases, the circular target DNAs include a drug resistance marker (e.g., a nucleotide sequence encoding a protein that provides for drug resistance). In some embodiments, a population of circular target DNAs are generated from a population of linear DNA molecules (e.g., via intramolecular ligation). For example, a subject method can include a step of circularizing a population of linear DNA molecules (e.g., a population of PCR products, a population of linear viral genomes, a population of products from a restriction digest, etc.) to generate a population of circular target DNAs. In some cases, members of such a population are identical (e.g., many copies of a PCR product or restriction digest can be used to generate a population of circular DNAs, where each circular DNA is identical). In some cases, members of such a population can be different from one another (e.g., two or more different PCR products or restriction digest products can be circularized).

In some embodiments, the members of a population of circular target DNAs are identical (are copies of one another). In some embodiments, the members of a population of circular target DNAs are not identical (e.g., in some cases the population of circular target DNAs can itself be a deletion library). For example, the population of circular target DNAs can be a library of known deletion mutants (e.g., known viral deletion mutants). As another example, if two rounds of a subject method are performed, the starting population of target DNAs for the second round can be a deletion library (e.g., generated during a first round of deletion) where members of the library include deletions of different sections of DNA relative to other members of the library. Such a library can serve as a population of circular target DNAs, e.g., a transposon cassette can still be introduced into the population. Performing a second round of deletion in this manner can therefore generate constructs with deletions at multiple different entry points. As an illustrative example, for a target DNA of 20 kb (kilobases) in length, the first round of deletion might have deleted bases 2000 through 2650 for a one member (of the library that was generated), of which multiple copies would likely be present. A second round of deletion might generate two new members, both of which are generated from copies of the same deletion member. Thus, for example, one new member might be generated with bases 3500 through 3650 deleted (in addition to bases 2000 through 2650), while a second new member might be generated with bases 1500 through 1580 deleted (in addition to bases 2000 through 2650). Thus, multiple rounds of deletion (e.g., 2, 3, 4, 5, etc.) can produce complex deletion libraries. In some cases, more than one round of library generation is performed where the second round includes the insertion of a transposon cassette, e.g., as described above.

For example, in some cases, a first round of deletion is performed using a CRISPR/Cas endonuclease to generate the cleaved linear target DNAs by targeting the CRISPR/Cas endonuclease to pre-selected sites within the population of circular target DNAs (e.g., by designing guide RNAs, e.g., at pre-selected spacing, to target a known sequence of interest such as a viral genome). After exonuclease treatment and circularization to generate a first library of circularized deletion DNAs, the library of circularized deletion DNAs is used as input (a population of circular target DNAs) for a second round of deletion. Thus, one or more target sequences for one or more sequence specific DNA endonucleases (e.g., one or more meganucleases) is inserted (e.g., at random positions via a transposon cassette) into the library of circularized deletion DNAs to generate a population of transposon-inserted circular target DNAs, and the method is continued. In some such cases, the first round of deletion might only target a small number of locations of interest for deletion (one location, e.g., using only one guide RNA that targets a particular location; or a small number of locations, e.g., using a small number of guide RNAs to target a small number of locations), while the second round is used to generate deletion constructs that include the first deletion plus a second deletion.

Viral Genome

In some cases, the circular target DNAs include a viral genome (e.g., a whole viral genome, a viral genome that includes a deletion, a partial viral genome, etc.). Thus, in some cases the subject methods are used to generate a library of viral deletion mutants. In some such cases, a library of generated viral deletion mutants can be considered a library of potential defective interfering particles (DIPs). DIPs are mutant versions of viruses that include genomic deletions such that they are unable to replicate except when complemented by wild-type virus replicating within the same cell. DIPs can arise naturally because viral genomes encode both cis- and trans-acting elements. Trans-acting elements (trans-elements) code for gene products, such as capsid proteins or transcription factors, and cis-acting elements (cis-elements) are regions of the viral genome that interact with trans-element products to achieve productive viral replication including viral genome amplification, encapsidation, and viral egress. In other words, the viral genome of a DIP can still be copied and packaged into viral particles if the missing (deleted) trans-elements are provided in trans (e.g., by a co-infecting virus). In some cases, a DIP can be used therapeutically to reduce viral infectivity of a co-infecting virus, e.g., by competing for and therefore diluting out the available trans-elements. In some cases, a DIP can be used as a therapeutic (e.g., as a treatment for viral disease), and in some cases a DIP is therefore referred to as a therapeutic interfering particle (TIP). While DIPs can arise naturally, methods of this disclosure can be used to generate DIPs, e.g., by generating a deletion library of viral genomes. DIPs can then be identified from such a deletion library by sequencing the library members to identify those predicted to be DIPs. Alternatively, or in addition, a generated deletion library can be screened, e.g., by introducing the library into cells, to identify those members with viral genomes having the desired function. Additional description of DIPs and TIPs and uses thereof is provided in U.S. Patent Application Publication No. 20160015759, the disclosure of which is incorporated by reference herein in its entirety.

Thus, in some cases a subject method includes introducing members of the library of generated deletion constructs (e.g., deletion-containing viral genomes) into a target cell (e.g., a eukaryotic cell, such as a mammalian cell, such as a human cell) and assaying for infectivity. In some such cases, the assaying step also includes complementation of the library members with a co-infecting virus.

Such introducing is meant herein to encompass any form of introduction of nucleic acids into cells (e.g., electroporation, transfection, lipofection, nanoparticle delivery, viral delivery, and the like). For example, such 'introduction' encompasses infecting mammalian cells in culture (e.g., with members of a generated library of circularized deletion viral DNAs, i.e., with viral particles that contain viral genomes encoded by the members of the generated library of circularized deletion viral DNAs). In some cases, as described in more detail below, a method includes generating from the generated library of circularized deletion DNAs, at least one of: linear double stranded DNA (dsDNA) products, linear single stranded DNA (ssDNA) products, linear single stranded RNA (ssRNA) products, and linear double stranded RNA (dsRNA) products. Thus in some such cases, a subject method includes introducing said linear dsDNA products, linear ssDNA products, linear ssRNA products, and/or linear dsRNA products into mammalian cells (e.g., via any convenient method for introducing nucleic acids into cells, including but not limited to electroporation, transfection, lipofection, nanoparticle delivery, viral delivery, and the like). Such methods can also include assaying for viral infectivity.

Assaying for viral infectivity can be performed using any convenient method and many various methods will be known to one of ordinary skill in the art. Assaying for viral infectivity can be performed on the cells into which the members of the library of circularized deletion DNAs (and/or at least one of: linear double stranded DNA (dsDNA) products, linear single stranded DNA (ssDNA) products, linear single stranded RNA (ssRNA) products, and linear double stranded RNA (dsRNA) products generated from the library of circularized deletion DNAs) are introduced. For example, in some cases the members and/or products are introduced via virus. In some cases, members of the library of circularized deletion DNAs (and/or at least one of: linear dsDNA products, linear ssDNA products, linear ssRNA products, and linear dsRNA products generated from the library of circularized deletion DNAs) are introduced into a first population of cells (e.g., mammalian cells) in order to generate viral particles, and the viral particles are then used to contact a second population of cells (e.g., mammalian cells). Thus, as used herein, unless otherwise explicitly described, the phrase "assaying for viral infectivity" encompasses both of the above scenarios (e.g., encompasses assaying for infectivity in the cells into which the members and/or products were introduced, and also encompasses assaying the second population of cells as described above).

In some embodiments a subject method (e.g., a method of generating and identifying a DIP) includes, after generating a deletion library (e.g., a library of circularized deletion viral DNAs), a high multiplicity of infection (MOI) screen (e.g., utilizing an MOI of ≥2). As used herein, a "high MOI" is an MOI of 2 or more (e.g., 2.5 or more, 3 or more, 5 or more, etc.). In some cases, a subject method uses a high MOI. Thus, in some cases, a subject method uses an MOI (a high MOI) of 2 or more, 3 or more, or 5 or more. In some cases, a subject method uses an MOI (a high MOI) in a range of from 2-150 (e.g., from 2-100, 2-80, 2-50, 2-30, 3-150, 3-100, 3-80, 3-50, 3-30, 5-150, 5-100, 5-80, 5-50, or 5-30). In some cases, a subject method uses an MOI (a high MOI) in a range of from 3-100 (e.g., 5-100). At high MOI, many (if not all) cells are infected by more than one virus, which allows for complementation of defective viruses by wildtype counterparts. Repeated passaging of deletion mutant libraries at high-MOI can select for mutants that can be mobilized effectively by a wild type virus (e.g., HIV-1) (e.g., FIG. 17). For example, in some cases the method includes infecting mammalian cells in culture with members of the library of circularized deletion viral DNAs at a high multiplicity of infection (MOI), culturing the infected cells for a period of time ranging from 12 hours to 2 days (e.g., from 12 hours to 36 hours or 12 hours to 24 hours), adding naive cells to the to the culture, and harvesting virus from the cells in culture. However, this screening step can in some cases select for DIPs/TIPs which can be mobilized effectively by the wildtype virus, but are cytopathic in the absence of the wildtype coinfection.

Thus, in some embodiments a subject method (e.g., a method of generating and identifying a DIP) includes a more stringent screen (referred to herein as a "low multiplicity of infection (MOI) screen"). As used herein, a "low MOI" is an MOI of less than 1 (e.g., less than 0.8, less than 0.6, etc.). In some cases, a subject method uses a low MOI. Thus, in some cases, a subject method uses an MOI (a low MOI) of less than 1 (e.g., less than 0.8, less than 0.6). In some cases, a subject method uses an MOI (a low MOI) in a range of from 0.001-0.8 (e.g., from 0.001-0.6, 0.001-0.5, 0.005-0.8, 0.005-0.6, 0.01-0.8, or 0.01-0.5). In some cases, a subject method uses an MOI (a low MOI) in a range of from 0.01-0.5. For example, a low-MOI infection of target cells with a deletion library (e.g., utilizing an MOI of <1) can be alternated with a high-MOI infection of the transduced population with wildtype virus (e.g., HIV-1) to mobilize DIPs to naive cells (e.g., see FIG. 19). In between successive infections, the cells can be propagated in the presence of a drug to prevent further rounds of replication (e.g., using a protease inhibitor such as Darunavir for HIV-1). During the recovery period, cells infected with wild type virus (e.g., HIV-1 infected cells) will be killed, but cells transduced by well-behaving mutants (which do not produce cell-killing trans-factors) will be maintained. In this fashion, mutants that do not kill their transduced host-cell but can mobilized during wildtype virus coinfection can be selected. Thus, in some cases a subject method includes infecting mammalian cells in culture with members of the library of circularized deletion viral DNAs at a low multiplicity of infection (MOI), culturing the infected cells in the presence of an inhibitor of viral replication for a period of time ranging from 1 day to 6 days (e.g., from 1 day to 5 days, from 1 day to 4 days, from 1 day to 3 days, or from 1 day to 2 days), infecting the cultured cells with functional virus at a high MOI, culturing the infected cells for a period of time ranging from 12 hours to 4 days (e.g., 12 hours to 72 hours, 12 hours to 48 hours, or 12 hours to 24 hours), and harvesting virus from the cultured cells.

In some embodiments, a subject method includes (a) inserting a target sequence for a sequence specific DNA endonuclease into a population of circular target viral DNAs, each comprising a viral genome, to generate a population of sequence-inserted viral DNAs; (b) contacting the population of sequence-inserted viral DNAs with the sequence specific DNA endonuclease to generate a population of cleaved linear viral DNAs; (c) contacting the population of cleaved linear viral DNAs with an exonuclease to generate a population of deletion DNAs; (d) circularizing (e.g., via ligation) the deletion DNAs to generate a library of circularized deletion viral DNAs; and (e) sequencing members of the library of circularized deletion viral DNAs to identify deletion interfering particles (DIPs). In some cases, the method includes inserting a barcode sequence prior to or simultaneous with step (d).

In some cases the inserting of step (a) includes inserting a transposon cassette into the population of circular target viral DNAs, wherein the transposon cassette includes the target sequence for the sequence specific DNA endonuclease, and where the generated population of sequence-inserted viral DNAs is a population of transposon-inserted viral DNAs. In some cases (e.g., in some cases when using a CRISPR/Cas endonuclease—as discussed above), a subject method does not include step (a), and the first step of the method is instead cleaving members of the library in different locations relative to one another, which step can be followed by the exonuclease step.

Target Sequence and Sequence Specific DNA Endonucleases

In some cases a target sequence for a sequence specific DNA endonuclease is inserted into a target DNA, e.g., population of target DNAs, e.g., in some cases via insertion of a transposon cassette. The 'target sequence' is also referred to herein as a "recognition sequence" or "recognition site". The term "sequence specific endonuclease" is used herein to refer to a DNA endonuclease that binds to and/or 'recognizes' the 'target sequence' in a target DNA, and cleaves the DNA. In other words, a sequence specific DNA endonuclease recognizes a specific sequence (a recognition sequence) within a target DNA molecule and cleaves the molecule based on that recognition. In some cases the sequence specific DNA endonuclease cleaves the target DNA within the recognition sequence and in some cases it cleaves outside of the recognition sequence (e.g., in the case of type IIS restriction endonucleases).

The term sequence specific DNA endonuclease encompasses, e.g., restriction enzymes, meganucleases, and programmable genome editing nucleases. Thus, examples of sequence specific endonucleases include but are not limited to: restriction endonucleases such as EcoRI, EcoRV, BamHI, etc.; meganucleases such as LAGLIDADG meganucleases (LMNs), I-SceI, I-CeuI, I-CreI, I-DmoI, I-ChuI, I-DirI, I-FlmuI, I-FlmuII, I-AniI, I-SceIV, I-CsmI, I-PanI, I-PanII, I-PanMI, I-SceII, I-PpoI, I-SceIII, I-LtrI, I-GpiI, I-GZeI, I-OnuI, I-HjeMI, I-MsoI, I-TevI, I-TevII, I-TevIII, PI-MleI, PI-MtuI, PI-PspI, PI-Tli I, PI-Tli II, PI-SceV, and the like; and programmable gene editing endonucleases such as Zinc Finger Nucleases (ZFNs), transcription activator like effector nuclease (TALENs), and CRISPR/Cas endonucleases. In some cases, the sequence specific endonuclease of a subject composition and/or method is selected from: a meganuclease and a programmable gene editing endonuclease. In some cases, the sequence specific endonuclease of a subject composition and/or method is selected from: a meganuclease, a ZFN, a TALEN, and a CRISPR/Cas endonuclease (e.g., Cas9, Cpf1, and the like).

In some cases, the sequence specific endonuclease of a subject composition and/or method is a meganuclease. In some cases the meganuclease is selected from: LAGLIDADG meganucleases (LMNs), I-SceI, I-CeuI, I-CreI, I-DmoI, I-ChuI, I-DirI, I-FlmuI, I-FlmuII, I-AniI, I-SceIV, I-CsmI, I-PanI, I-PanII, I-PanMI, I-SceII, I-PpoI, I-SceIII, I-LtrI, I-GpiI, I-GZeI, I-OnuI, I-HjeMI, I-MsoI, I-TevI, I-TevII, I-TevIII, PI-MleI, PI-MtuI, PI-PspI, PI-Tli I, PI-Tli II, and PI-SceV. In some cases, the meganuclease I-SceI is used. In some cases, the meganuclease I-CeuI is used. In some cases, the meganucleases I-SceI and I-CeuI are used.

In some cases the sequence specific DNA endonuclease is a programmable genome editing nuclease. The term "programmable genome editing nuclease" is used herein to refer to endonucleases that can be targeted to different target sites (recognition sequences) within a target DNA. Examples of suitable programmable genome editing nucleases include but are not limited to zinc finger nucleases (ZFNs), TAL-effector DNA binding domain-nuclease fusion proteins (transcription activator-like effector nucleases (TALENs)), and CRISPR/Cas endonucleases (e.g., class 2 CRISPR/Cas endonucleases such as a type II, type V, or type VI CRISPR/Cas endonucleases). Thus, in some embodiments, a programmable genome editing nuclease is selected from: a ZFN, a TALEN, and a CRISPR/Cas endonuclease (e.g., a class 2 CRISPR/Cas endonuclease such as a type II, type V, or type VI CRISPR/Cas endonuclease). In some cases, the sequence specific endonuclease of a subject composition and/or method is a CRISPR/Cas endonuclease (e.g., Cas9, Cpf1, and the like). In some cases, the sequence specific endonuclease of a subject composition and/or method is selected from: a meganuclease, a ZFN, and a TALEN.

Information related to class 2 type II CRISPR/Cas endonuclease Cas9 proteins and Cas9 guide RNAs (as well as methods of their delivery) (as well as information regarding requirements related to protospacer adjacent motif (PAM) sequences present in targeted nucleic acids) can be found in the art, for example, see Jinek et al., Science. 2012 Aug. 17; 337(6096):816-21; Chylinski et al., RNA Biol. 2013 May; 10(5):726-37; Ma et al., Biomed Res Int. 2013; 2013: 270805; Hou et al., Proc Natl Acad Sci USA. 2013 Sep. 24; 110(39):15644-9; Jinek et al., Elife. 2013; 2:e00471; Pattanayak et al., Nat Biotechnol. 2013 September; 31(9):839-43; Qi et al, Cell. 2013 Feb. 28; 152(5):1173-83; Wang et al., Cell. 2013 May 9; 153(4):910-8; Auer et. al., Genome Res. 2013 Oct. 31; Chen et. al., Nucleic Acids Res. 2013 Nov. 1; 41(20):e19; Cheng et. al., Cell Res. 2013 October; 23(10): 1163-71; Cho et. al., Genetics. 2013 November; 195(3): 1177-80; DiCarlo et al., Nucleic Acids Res. 2013 April; 41(7):4336-43; Dickinson et. al., Nat Methods. 2013 October; 10(10):1028-34; Ebina et. al., Sci Rep. 2013; 3:2510; Fujii et. al, Nucleic Acids Res. 2013 Nov. 1; 41(20):e187; Hu et. al., Cell Res. 2013 November; 23(11):1322-5; Jiang et. al., Nucleic Acids Res. 2013 Nov. 1; 41(20):e188; Larson et. al., Nat Protoc. 2013 November; 8(11):2180-96; Mali et. al., Nat Methods. 2013 October; 10(10):957-63; Nakayama et. al., Genesis. 2013 December; 51(12):835-43; Ran et. al., Nat Protoc. 2013 November; 8(11):2281-308; Ran et. al., Cell. 2013 Sep. 12; 154(6):1380-9; Upadhyay et. al., G3 (Bethesda). 2013 Dec. 9; 3(12):2233-8; Walsh et. al., Proc Natl Acad Sci USA. 2013 Sep. 24; 110(39):15514-5; Xie et. al., Mol Plant. 2013 Oct. 9; Yang et. al., Cell. 2013 Sep. 12; 154(6):1370-9; Briner et al., Mol Cell. 2014 Oct. 23; 56(2): 333-9; and U.S. patents and patent applications: U.S. Pat. Nos. 8,906,616; 8,895,308; 8,889,418; 8,889,356; 8,871, 445; 8,865,406; 8,795,965; 8,771,945; 8,697,359; 20140068797; 20140170753; 20140179006; 20140179770; 20140186843; 20140186919; 20140186958; 20140189896; 20140227787; 20140234972; 20140242664; 20140242699; 20140242700; 20140242702; 20140248702; 20140256046; 20140273037; 20140273226; 20140273230; 20140273231; 20140273232; 20140273233; 20140273234; 20140273235; 20140287938; 20140295556; 20140295557; 20140298547; 20140304853; 20140309487; 20140310828; 20140310830; 20140315985; 20140335063; 20140335620; 20140342456; 20140342457; 20140342458; 20140349400; 20140349405; 20140356867; 20140356956; 20140356958; 20140356959; 20140357523; 20140357530; 20140364333; and 20140377868; all of which are hereby incorporated by reference in their entirety. Examples and guidance related to type V CRISPR/Cas endonucleases (e.g., Cpf1) or type VI CRISPR/Cas endonucleases and guide RNAs (as well as information regarding requirements related to protospacer adjacent motif (PAM) sequences present in targeted nucleic acids) can be found in the art, for example, see Zetsche et al, Cell. 2015 Oct. 22; 163(3):759-71; Makarova et al, Nat Rev Microbiol. 2015 November; 13(11):722-36; and Shmakov et al., Mol Cell. 2015 Nov. 5; 60(3):385-97.

Useful designer zinc finger modules include those that recognize various GNN and ANN triplets (Dreier, et al., (2001) J Biol Chem 276:29466-78; Dreier, et al., (2000) J Mol Biol 303:489-502; Liu, et al., (2002) J Biol Chem 277:3850-6), as well as those that recognize various CNN or TNN triplets (Dreier, et al., (2005) J Biol Chem 280:35588-97; Jamieson, et al., (2003) Nature Rev Drug Discov 2:361-8). See also, Durai, et al., (2005) Nucleic Acids Res 33:5978-90; Segal, (2002) Methods 26:76-83; Porteus and Carroll, (2005) Nat Biotechnol 23:967-73; Pabo, et al., (2001) Ann Rev Biochem 70:313-40; Wolfe, et al., (2000) Ann Rev Biophys Biomol Struct 29:183-212; Segal and Barbas, (2001) Curr Opin Biotechnol 12:632-7; Segal, et al., (2003) Biochemistry 42:2137-48; Beerli and Barbas, (2002) Nat Biotechnol 20:135-41; Carroll, et al., (2006) Nature Protocols 1:1329; Ordiz, et al., (2002) Proc Natl Acad Sci USA 99:13290-5; Guan, et al., (2002) Proc Natl Acad Sci USA 99:13296-301.

For more information on ZFNs and TALENs (as well as methods of their delivery), refer to Sanjana et al., Nat Protoc. 2012 Jan. 5; 7(1):171-92 as well as international patent applications WO2002099084; WO00/42219; WO02/42459; WO2003062455; WO03/080809; WO05/014791; WO05/ 084190; WO08/021207; WO09/042186; WO09/054985; WO10/079430; and WO10/065123; U.S. Pat. Nos. 8,685, 737; 6,140,466; 6,511,808; and 6,453,242; and US Patent Application Nos. 2011/0145940, 2003/0059767, and 2003/ 0108880; all of which are hereby incorporated by reference in their entirety.

In some cases (e.g., in the case of restriction enzymes), the recognition sequence is a constant (does not change) for the given protein (e.g., the recognition sequence for the BamHI restriction enzyme is G^GATCC). In some cases, the sequence specific DNA endonuclease is 'programmable' in the sense that the protein (or its associated RNA in the case of CRISPR/Cas endonucleases) can be modified/engineered to recognize a desired recognition sequence. In some cases (e.g., in cases where the sequence specific DNA endonuclease is a meganuclease and/or in cases where the sequence specific DNA endonuclease is a CRISPR/Cas endonuclease), the recognition sequence has a length of 14 or more nucleotides (nt) (e.g., 15 or more, 16 or more, 17 or more, 18 or more, 19 or more, or 20 or more nt). In some cases the recognition sequence has a length in a range of from 14-40 nt (e.g., 14-35, 14-30, 14-25, 15-40, 15-35, 15-30, 15-25, 16-40, 16-35, 16-30, 16-25, 17-40, 17-35, 17-30, or 17-25 nt). In some cases the recognition sequence has a length of 14 or more base pairs (bp) (e.g., 15 or more, 16 or more, 17 or more, 18 or more, 19 or more, or 20 or more bp). In some cases the recognition sequence has a length in a range of from 14-40 bp (e.g., 14-35, 14-30, 14-25, 15-40, 15-35, 15-30, 15-25, 16-40, 16-35, 16-30, 16-25, 17-40, 17-35, 17-30, or 17-25 bp).

When referring above to the lengths of a recognition sequence, it would be readily understood to one of ordinary skill in the art that some proteins recognize the double-stranded helix and the recognition sequence can therefore be thought of in terms of base pairs (bp), while in some cases (e.g., in the case of CRISPR/Cas endonucleases) the recognition sequence is recognized in single stranded form (e.g., a guide RNA of a CRISPR/Cas endonuclease can hybridize to the target DNA) and the recognition sequence can therefore be thought of in terms of nucleotides (nt). However, when using 'bp' or 'nt' herein when referring to a recognition sequence, this terminology is not intended to be limiting. As an example, if a particular method or composition described herein encompasses both types of sequence specific DNA endonuclease (those that recognize 'bp' and those that recognize 'nt'), either of the terms 'nt' or 'bp' can be used without limiting the scope of the sequence specific DNA endonuclease, because one of ordinary skill in the art would readily understand which term ('nt' or 'bp') would appropriately apply, and would understand that this depends on which protein is chosen. In the case of a length limitation of the recognition sequence, one of ordinary skill in the art would understand that the length limitation being discussed equally applies regardless of whether the term 'nt' or 'bp' is used.

Chew Back (Exonuclease Digestion)

After the circular target DNAs are cleaved, generating a population of cleaved linear target DNAs, the open ends of the linear target DNAs are digested (chewed back) by exonucleases. Many different exonucleases will be known to one of ordinary skill in the art and any convenient exonuclease can be used. In some cases, a 5' to 3' exonuclease is used. In some cases, a 3' to 5' exonuclease is used. In some cases, an exonuclease is used that has both 5' to 3' and 3' to 5' exonuclease activity. In some cases, more than one exonuclease is used (e.g., 2 exonucleases). In some cases, the population of cleaved linear target DNAs is contacted with a 5' to 3' exonuclease and a 3' to 5' exonuclease (e.g., simultaneously or one before the other).

In some cases, a T4 DNA polymerase is used as a 3' to 5' exonuclease (in the absence of dNTPs, T4 DNA polymerase has 3' to 5' exonuclease activity). In some cases, RecJ is used as a 5' to 3' exonuclease. In some cases T4 DNA polymerase (in the absence of dNTPs) and RecJ are used. Examples of exonucleases include but are not limited to: DNA polymerase (e.g., T4 DNA polymerase) (in the absence of dNTPS), lambda exonuclease (5'→3'), T5 exonuclease (5'→3'), exonuclease III (3'→5'), exonuclease V (5'→3' and 3'→5'), T7 exonuclease (5'→3'), exonuclease T, exonuclease VII (truncated)(5'→3'), and RecJ exonuclease (5'→3').

The rate of DNA digestion (chew back) is sensitive to temperature, thus the size of the desired deletion can be controlled by regulating the temperature during exonuclease digestion. For example, in the examples section below when using T4 DNA polymerase (in the absence of dNTPs) and RecJ as the exonucleases, the double-end digestion rate (chewback rate) proceeded at a rate of 50 bp/min at 37° C. and at a reduced rate at lower temperatures (e.g., as discussed in the examples section below). Thus, temperature can be decreased or increased and/or digestion time can be decreased or increased to control the size of deletion (i.e., the amount of exonuclease digestion). For example, in some cases, the temperature and time are adjusted so that exonuclease digestion causes a deletion in a desired size range. As an illustrative example, if a deletion in a range of from 500-1000 base pairs (bp) is desired, the time and temperature of digestion can be adjusted so that 250-500 nucleotides are removed from each end of the linearized (cut) target DNA, i.e., the size of the deletion is the sum of the number of nucleotides removed from each end of the linearized target DNA. In some cases, the temperature and time are adjusted so that exonuclease digestion causes a deletion having a size in a range of from 20-1000 bp (e.g., from 20-50, 40-80, 20-100, 40-100, 20-200, 40-200, 60-100, 60-200, 80-150, 80-250, 100-250, 150-350, 100-500, 200-500, 200-700, 300-800, 400-800, 500-1000, 700-1000, 20-800, 50-1000, 100-1000, 250-1000, 50-1000, 50-750, 100-1000, or 100-750 bp).

In some cases, contacting with an exonuclease (one or more exonucleases) is performed at a temperature in a range of from room temperature (e.g., 25° C.) to 40° C. (e.g., from 25-37° C., 30-37° C., 32-40° C., or 30-40° C.). In some cases contacting with an exonuclease is performed at 37° C. In some cases contacting with an exonuclease is performed at 32° C. In some cases contacting with an exonuclease is performed at 30° C. In some cases contacting with an exonuclease is performed at 25° C. In some cases contacting with an exonuclease is performed at room temperature.

In some cases, the target DNA is contacted with an exonuclease (one or more exonucleases) for a period of time in a range of from 10 seconds to 40 minutes (e.g., from 10 seconds to 30 minutes, 10 seconds to 20 minutes, 10 seconds to 15 minutes, 10 seconds to 10 minutes, 30 seconds to 30 minutes, 30 seconds to 20 minutes, 30 seconds to 15 minutes, 30 seconds to 12 minutes, 30 seconds to 10 minutes, 1 to 40 minutes, 1 to 30 minutes, 1 to 20 minutes, 1 to 15 minutes, 1 to 10 minutes, 3 to 40 minutes, 3 to 30 minutes, 3 to 20 minutes, 3 to 15 minutes, 3 to 12 minutes, or 3 to 10 minutes). In some cases the contacting is for a period of time in a range of from 20 seconds to 15 minutes.

After DNA digestion (chew back), the remaining overhanging DNA ends can be repaired (e.g., using T4 DNA Polymerase plus dNTPs) or in some cases the single stranded overhangs can be removed (e.g., using a nuclease such as mung bean nuclease that cleaves single stranded DNA but not double stranded DNA). For example, if only a 5' to 3' or 3' to 5' exonuclease is used, a nuclease specific for single stranded DNA (i.e., that does not cut double stranded DNA) (e.g., mung bean nuclease) can be used to remove the overhang.

The step of contacting with one or more exonucleases (i.e., chew back) can be carried out in the presence or absence of a single strand binding protein (SSB protein). An SSB is a protein that binds to exposed single stranded DNA ends, which can achieve numerous results, including but not limited to: (i) helping stabilize the DNA by preventing nucleases from accessing the DNA, and (ii) preventing hairpin formation within the single stranded DNA. Examples of SSB proteins include but are not limited to: a eukaryotic SSB protein (e.g., replication protein A (RPA)); bacterial SSB protein; and viral SSB proteins. In some cases, the step of contacting with one or more exonucleases is performed in the presence of an SSB. In some cases, the step of contacting with one or more exonucleases is performed in the absence of an SSB.

Barcode

In some embodiments, the members of a library are 'tagged' by adding a barcode to the target DNAs after exonuclease digestion (and after remaining overhanging DNA ends are repaired/removed). The addition of a barcode can be performed prior to or simultaneously with re-circularizing (ligation). As used herein, term "barcode" is used to mean a stretch of nucleotides having a sequence that uniquely tags members of the library for future identification. For example, in some cases, a barcode cassette (from a pool of random barcode cassettes) can be added and the library sequenced so that it is known which barcode sequence is associated with which particular member, i.e., with which particular deletion (e.g., a lookup table can be created such that each member of a deletion library has a unique barcode). In this way, members of a deletion library can be tracked and accounted for by virtue of presence of the barcode (instead of having to identify the members by determining the location of deletion). As can be readily appreciated, identifying the presence of a short stretch of nucleotides using any convenient assay is much more easily accomplished than attempted to isolate and sequence individual members (in order to determine location of deletion) each time the library is used for a given experiment. For example, one can readily determine which library members are present before an experiment (e.g., before introducing library members into cells to assay for viral infectivity), and compare this to which members are present after the experiment by simply assaying for the presence of the barcode before and after, e.g., using high throughput sequencing, a microarray, PCR, qPCR, or any other method that can detect the presence/absence of a barcode sequence.

In some cases, a barcode is added as a cassette. A barcode cassette is a stretch of nucleotides that have at least one constant region (a region shared by all members receiving the cassette) and a barcode region (i.e., a barcode sequence—a region unique to the members that receive the barcode such that the barcode uniquely marks the members of the library). For example, a barcode cassette can include (i) a constant region that is a primer site, which site is in common among the barcode cassettes used, and (ii) a barcode sequence that is a unique tag, e.g., can be a stretch of random sequence. In some cases, a barcode cassette includes a barcode region flanked by two constant regions (e.g., two different primer sites). As an illustrative example, in some cases a barcode cassette is a 60 bp cassette that includes a 20 bp random barcode flanked by 20 bp primer binding sites (e.g., see FIG. 6).

A barcode sequence can have any convenient length, and is preferably long enough so that it uniquely marks the members of a given library of interest. In some cases, the barcode sequence has a length of from 15 bp to 40 bp (e.g., from 15-35 bp, 15-30 bp, 15-25 bp, 17-40 bp, 17-35 bp, 17-30 bp, or 17-25 bp). In some cases, the barcode sequence has a length of 20 bp. Likewise, a barcode cassette can have any convenient length, and this length depends on the length of the barcode sequence plus the length of the constant region(s). In some cases, the barcode cassette has a length of from 40 bp to 100 bp (e.g., from 40-80 bp, 45-100 bp, 45-80 bp, 45-70 bp, 50-100 bp, 50-80 bp, or 50-70 bp). In some cases, the barcode cassette has a length of 60 bp.

A barcode or barcode cassette can be added using any convenient method. For example, a target DNA can be recircularized by ligation to a 3'-dT-tailed barcode cassette drawn from a pool of random barcode cassettes. The nicked hemiligation product can then be sealed and transformed into a host cell, e.g., a bacterial cell.

Generating a Product

In some cases, a subject method includes a step of generating (e.g., from a generated library of circularized deletion DNAs) at least one of: linear double stranded DNA (dsDNA) products (e.g., via cleavage of the circular DNA, via PCR, etc.), linear single stranded DNA (ssDNA) products (e.g., via transcription and reverse transcription), linear single stranded RNA (ssRNA) products (e.g., via transcription), and linear double stranded RNA (dsRNA) products. If so desired, the linear products can then be introduced into a cell (e.g., mammalian cell). For example, a common technique for RNA viruses like polio, dengue, and Zika is to perform in vitro transcription from a dsDNA template (circular or linear) to make RNA, and then to introduce this RNA into cells (e.g., via electroporation, chemical methods, etc.) to generate viral stocks.

Also within the scope of the disclosure are kits. For example, in some cases a subject kit can include one or more of (in any combination): (i) a population of circular target DNAs as described herein, (ii) a transposon cassette as described herein, (iii) a sequence specific DNA endonuclease as described herein, (iv) one or more guide RNAs for a CRISPR/Cas endonuclease as described herein, (v) a population of barcodes and/or barcode cassettes as described herein, and (vi) a population of host cells, e.g., for propagation of the library, for assaying for viral infectivity, etc., as described herein. In some cases, a subject kit can include instructions for use. Kits typically include a label indicating the intended use of the contents of the kit. The term label includes any writing, or recorded material supplied on or with the kit, or which otherwise accompanies the kit.

Deletion Mutants

The present disclosure provides HIV-1 deletion mutants, e.g., interfering, conditionally replicating, HIV-1 deletion mutants, and related constructs. For example, the present disclosure provides HIV-1 deletion mutants having one or more of the deletions identified in Table 4 relative to the wild type HIV-1 pNL4-3 sequence. The present disclosure also provides HIV deletion mutants having the sequences identified by SEQ ID NOs.: 56-116 in Table 4, e.g., hiv01-hiv60.

More broadly, the present disclosure identifies specific regions of the HIV-1 genome that should be retained and specific regions of the HIV-1 genome that can be deleted in order to provide interfering, conditionally replicating, HIV deletion mutants and related constructs. For example, in order to function as TIPs, HIV-1 deletion mutants should retain all cis-acting elements. From the high MOI screen described herein with reference to FIGS. 26 and 27, these regions are identified as CAE1 (1115 bp: nt 1-1114 of NL4-3 provirus), CAE2 (126 bp: nt 4779-4905 of NL4-3), CAE3 (671 bp: nt 7710-8381 of NL4-3), and CAE4 (684 bp: nt 9025-9709 of NL4-3). The minimal size/identity of an HIV-1 TIP is a concatenation of these 4 elements (about a 2596 bp provirus). Expressed in common terms used by HIV-1 virologists, CAE1 corresponds to the 5' LTR through the first 325 bp of gag. CAE2 is the cPPT/CTS. CAE3 is the RRE-SA7 (Rev Response Element to Splice Acceptor 7). CAE4 is the PPT and 5' LTR.

In addition to retaining cis-acting elements, HIV-1 TIPs which demonstrate interference with HIV-1 replication should have deletions in at least the gag and/or pol genes. For such TIPs, additional deletions in the accessory tract (vif, vpr, tat (exon 1), rev (exon 1), and/or vpu) may be more interfering than those with an intact accessory tract.

The deletion size for gag and/or pol may range, e.g., from about 800 bp to about 2500 bp, e.g., from about 900 bp to about 2400 bp, from about 1000 bp to about 2300 bp, from about 1100 bp to about 2200 bp, from about 1200 bp to about 2100 bp, from about 1300 bp to about 2000 bp, from about 1400 bp to about 1900 bp, from about 1500 bp to about 1800 bp, or from about 1600 bp to about 1700 bp.

In some embodiments, the deletion size for gag and/or pol may range from about 900 bp to about 2500 bp, from about 1000 bp to about 2500 bp, from about 1100 bp to about 2500 bp, from about 1200 bp to about 2500 bp, from about 1300 bp to about 2500 bp, from about 1400 bp to about 2500 bp, from about 1500 bp to about 2500 bp, from about 1600 bp to about 2500 bp, from about 1700 bp to about 2500 bp, from about 1800 bp to about 2500 bp, from about 1900 bp to about 2500 bp, from about 2000 bp to about 2500 bp, from about 2100 bp to about 2500 bp, from about 2200 bp to about 2500 bp, from about 2300 bp to about 2500 bp, or from about 2400 bp to about 2500 bp.

In some embodiments, the deletion size for gag and/or pol is about 800 bp, about 900 bp, about 1000 bp, about 1100 bp, about 1200 bp, about 1300 bp, about 1400 bp, about 1500 bp, about 1600 bp, about 1700 bp, about 1800 bp, about 1900 bp, about 2000 bp, about 2100 bp, about 2200 bp, about 2300 bp, about 2400 bp, or about 2500 bp.

The deletion size for the accessory tract (vif, vpr, tat (exon 1), rev (exon 1), and/or vpu) may range, e.g., from about 900 bp to about 1300 bp, e.g., from about 1000 bp to about 1200 bp, such as about 1100 bp. In some embodiments, the deletion size for the accessory tract (vif, vpr, tat, rev, and/or vpu) may range from about 1000 bp to about 1300 bp, e.g., from about 1100 bp to about 1300 bp, or from about 1200 bp to about 1300 bp. In some embodiments, the deletion size for the accessory tract (vif, vpr, tat (exon 1), rev (exon 1), and/or vpu) is about 900 bp, about 1000 bp, about 1100 bp, about 1200 bp, or about 1300 bp.

HIV-1 TIPs which demonstrate interference with HIV-1 replication may also include, e.g., in addition to a deletion in gag and/or pol, a deletion in nef. Such a deletion may be, e.g., from about 150 bp to about 200 bp, e.g., about 175 bp.

Exemplary Non-Limiting Aspects of the Disclosure

Aspects, including embodiments, of the present subject matter described above may be beneficial alone or in combination, with one or more other aspects or embodiments. Without limiting the foregoing description, certain non-limiting aspects of the disclosure numbered 1-56 are provided below. As will be apparent to those of ordinary skill in the art upon reading this disclosure, each of the individually numbered aspects may be used or combined with any of the preceding or following individually numbered aspects. This is intended to provide support for all such combinations of aspects and is not limited to combinations of aspects explicitly provided below:

1. A method of generating a deletion library, comprising:

(a) inserting a transposon cassette comprising a target sequence for a sequence specific DNA endonuclease into a population of circular target DNAs to generate a population of transposon-inserted circular target DNAs;

(b) contacting the population of transposon-inserted circular target DNAs with the sequence specific DNA endonuclease to generate a population of cleaved linear target DNAs;

(c) contacting the population of cleaved linear target DNAs with one or more exonucleases to generate a population of deletion DNAs; and (d) circularizing the deletion DNAs to generate a library of circularized deletion DNAs.

2. The method of 1, wherein the circular target DNAs are plasmids that comprise a viral genome.

3. The method of 2, wherein the method further comprises introducing members of the library of circularized deletion DNAs into mammalian cells, and assaying for viral infectivity.

4. The method of 2 or 3, wherein the method further comprises sequencing members of the library of circularized deletion DNAs to identify defective interfering particles (DIPs).

5. The method of any one of 1-4, wherein the sequence specific DNA endonuclease is selected from: a meganuclease, a CRISPR/Cas endonuclease, a zinc finger nuclease, or a TALEN.

6. The method of any one of 1-5, wherein the method comprises inserting a barcode sequence prior to or simultaneous with step (d).

7. The method of any one of 1-6, wherein the one or more exonucleases comprises T4 DNA polymerase.

8. The method of any one of 1-7, wherein the one or more exonucleases comprises a 3' to 5' exonuclease and a 5' to 3' exonuclease.

9. The method of any one of 1-8, wherein the one or more exonucleases comprises RecJ.

10. The method of any one of 1-9, wherein the step of contacting the population of cleaved linear target DNAs with one or more exonucleases is performed in the presence of a single strand binding protein (SSB).

11. The method of any one of 1-10, wherein the transposon cassette comprises a first recognition sequence positioned at or near one end of the transposon cassette and a second recognition sequence positioned at or near the other end of the transposon cassette.

12. The method of any one of 1-11, further comprising, prior to step (a), circularizing a population of linear DNA molecules to generate said population of circular target DNAs.

13. The method of 12, wherein the population of linear DNA molecules comprises one or more PCR products, one or more linear viral genomes, and/or one or more restriction digest products.

14. The method of any one of 1-13, further comprising introducing members of the library of circularized deletion DNAs into mammalian cells.

15. The method of any one of 1-13, further comprising generating from the library of circularized deletion DNAs, at least one of: linear double stranded DNA (dsDNA) products, linear single stranded DNA (ssDNA) products, linear single stranded RNA (ssRNA) products, and linear double stranded RNA (dsRNA) products.

16. The method of 15, further comprising introducing said linear dsDNA products, linear ssDNA products, linear ssRNA products, and/or linear dsRNA products into mammalian cells.

17. A method of generating and identifying a defective interfering particle (DIP), comprising:

(a) inserting a target sequence for a sequence specific DNA endonuclease into a population of circular target viral DNAs, each comprising a viral genome, to generate a population of sequence-inserted viral DNAs;

(b) contacting the population of sequence-inserted viral DNAs with the sequence specific DNA endonuclease to generate a population of cleaved linear viral DNAs;

(c) contacting the population of cleaved linear viral DNAs with an exonuclease to generate a population of deletion DNAs;

(d) circularizing the deletion DNAs to generate a library of circularized deletion viral DNAs; and (e) sequencing members of the library of circularized deletion viral DNAs to identify deletion interfering particles (DIPs).

18. The method of 17, comprising, prior to step (a), circularizing a population of linear DNA molecules to generate said population of circular target viral DNAs.

19. The method of 18, wherein the population of linear DNA molecules comprises one or more PCR products, one or more linear viral genomes, and/or one or more restriction digest products.

20. The method of any one of 17-19, wherein the method comprises inserting a barcode sequence prior to or simultaneous with step (d).

21. The method of any one of 17-20, further comprising (i) introducing members of the library of circularized deletion viral DNAs into mammalian cells; and (ii) assaying for viral infectivity.

22. The method of any one of 17-20, further comprising:

(i) generating from the library of circularized deletion viral DNAs, at least one of: linear double stranded DNA (dsDNA) products, linear single stranded DNA (ssDNA) products, linear single stranded RNA (ssRNA) products, and linear double stranded RNA (dsRNA) products.

23. The method of 22, further comprising, after step (i):

(ii) introducing said linear dsDNA products, linear ssDNA products, linear ssRNA products, and/or linear dsRNA products into mammalian cells; and (iii) assaying for viral infectivity.

24. The method of any one of 12-14, wherein the inserting of step (a) comprises inserting a transposon cassette into the population of circular target viral DNAs, wherein the transposon cassette comprises the target sequence for the sequence specific DNA endonuclease, and wherein said generated population of sequence-inserted viral DNAs is a population of transposon-inserted viral DNAs.

25. The method of any one of 17-24, wherein the method comprises, after step (d), infecting mammalian cells in culture with members of the library of circularized deletion viral DNAs at a high multiplicity of infection (MOI), culturing the infected cells for a period of time ranging from 12 hours to 2 days, adding naive cells to the to the culture, and harvesting virus from the cells in culture.

26. The method of any one of 17-25, wherein the method comprises, after step (d), infecting mammalian cells in culture with members of the library of circularized deletion viral DNAs at a low multiplicity of infection (MOI), culturing the infected cells in the presence of an inhibitor of viral replication for a period of time ranging from 1 day to 6 days, infecting the cultured cells with functional virus at a high MOI, culturing the infected cells for a period of time ranging from 12 hours to 4 days, and harvesting virus from the cultured cells.

27. A transposon cassette, comprising a DNA molecule comprising transposase compatible inverted terminal repeats (ITRs) flanking a sequence of interest, wherein the sequence of interest comprises a first copy and a second copy of a recognition sequence for a first meganuclease.

28. The transposon cassette of 27, wherein the sequence of interest includes a selectable marker gene, and said first and second copies flank the selectable marker gene.

29. The transposon cassette of 28, wherein the selectable marker gene encodes an antibiotic resistance protein.

30. The transposon cassette of any one of 27-29, comprising a first copy and a second copy of a recognition sequence for a second meganuclease.

31. The transposon cassette of 30, wherein the first and second copies of the recognition sequence for the second meganuclease flank a selectable marker gene.

32. The transposon cassette of any one of 27-31, wherein the transposase compatible inverted terminal repeats (ITRs) are cable of being recognized and utilized by a Tn5 transposase.

33. An HIV-1 deletion mutant construct comprising all cis-acting elements of HIV-1 (CAE1 (1115 bp: nt 1-1114 of NL4-3 provirus), CAE2 (126 bp: nt 4779-4905 of NL4-3), CAE3 (671 bp: nt 7710-8381 of NL4-3), and CAE4 (684 bp: nt 9025-9709 of NL4-3)) and a deletion in the gag and/or pol genes.

34. The HIV-1 deletion mutant construct of 33, wherein the construct comprises a deletion in one or more of the vif, vpr, tat, rev, and/or vpu genes.

35. The HIV-1 deletion mutant construct of 33 or 34, wherein the deletion in the gag and/or pol genes is from about 800 bp to about 2500 bp in length.

36. The HIV-1 deletion mutant construct of any one of 33-35, wherein the deletion in one or more of the vif, vpr, tat, rev, and/or vpu genes is from about 900 bp to about 1300 bp in length.

37. The HIV-1 deletion mutant construct of any one of 33-36, comprising a deletion in the nef gene.

38. The HIV-1 deletion mutant construct of 37, wherein the deletion in the nef gene is about 150 bp to about 200 bp in length.

39. The HIV-1 deletion mutant construct of any one of 33-38, comprising one or more of the deletions identified in Table 4 relative to the wild type HIV-1 NL4-3 proviral sequence.

40. The HIV-1 deletion mutant construct of any one of 33-39, wherein the construct does not include any heterologous nucleic acid sequence that encode a gene product.

41. An HIV-1 deletion mutant construct comprising the nucleic acid sequence set forth in any one of the SEQ ID NOs. 56-116 set forth in Table 4.

41(b). The HIV-1 deletion mutant construct of 41, wherein the construct is not replication competent and interferes with the replication of a wildtype HIV-1 virus, e.g., as identified in Table 9.

42. A particle comprising:

a) an HIV-1 deletion mutant construct of any one of 33-41; and b) a viral envelope protein.

43. The particle of 41, wherein the envelope protein comprises gp120.

44. The particle of 41, wherein the envelope protein is a non-HIV protein.

45. A pharmaceutical formulation comprising:

a) the particle of any one of 42-44, or a particle comprising the construct according to any one 33-41; and b) a pharmaceutically acceptable excipient.

46. A package for use in delivering the construct of one of 33-41 to an individual, the package comprising a container comprising the formulation of 45.

47. The package of 46, wherein the container is a syringe.

48. A method of reducing human immunodeficiency virus viral load in an individual, the method comprising administering to the individual an effective amount of a pharmaceutical formulation of 45.

49. The method of 48, further comprising administering to the individual an effective amount of an agent that inhibits an immunodeficiency virus function selected from viral replication, viral protease activity, viral reverse transcriptase activity, viral entry into a cell, viral integrase activity, viral Rev activity, viral Tat activity, viral Nef activity, viral Vpr activity, viral Vpu activity, and viral Vif activity.

50. The method of 48 or 49, wherein the individual has been diagnosed with an HIV infection.

51. The method of 48 or 49, wherein the individual is considered to be at higher risk than the general population of becoming infected with HIV.

52. The method of any one of 48-51, further comprising administering to the individual an effective amount of an agent that reactivates reactivating latent HIV integrated into the genome of a cell infected with HIV.

53. A biological fluid comprising the construct of any one of 33-41 or a derivative thereof.

54. The biological fluid of 53, wherein the biological fluid is plasma.

55. A method of generating a variant HIV-1 deletion mutant construct, the method comprising:

a) introducing the construct of any one of 33-41 into a first individual;

b) obtaining a biological sample from a second individual to whom the construct of any one of 33-41 has been transmitted from the first individual, wherein the construct present in the second individual is a variant of the construct of any one of 33-41; and c) cloning the variant construct from the second individual.

56. The HIV-1 deletion mutant construct of any one 33-41, wherein genomic RNA encoded by the construct is produced at a higher rate than wild-type HIV when present in a host cell infected with a wild-type HIV, such that the ratio of construct-encoded gRNA to wild-type HIV gRNA is higher than about 1 in the cell, and wherein the construct has a basic reproductive ratio ($R_0$)>1.

It will be apparent to one of ordinary skill in the art that various changes and modifications can be made without departing from the spirit or scope of the invention.

EXPERIMENTAL

The following examples are put forth so as to provide those of ordinary skill in the art with a complete disclosure and description of how to make and use the present invention, and are not intended to limit the scope of the invention nor are they intended to represent that the experiments below are all or the only experiments performed. Efforts have been made to ensure accuracy with respect to numbers used (e.g., amounts, temperature, etc.) but some experimental errors and deviations should be accounted for. Unless indicated otherwise, parts are parts by weight, molecular weight is weight average molecular weight, temperature is in degrees Centigrade, and pressure is at or near atmospheric.

All publications and patent applications cited in this specification are herein incorporated by reference as if each individual publication or patent application were specifically and individually indicated to be incorporated by reference.

The present invention has been described in terms of particular embodiments found or proposed to comprise preferred modes for the practice of the invention. It will be appreciated by those of skill in the art that, in light of the present disclosure, numerous modifications and changes can be made in the particular embodiments exemplified without departing from the intended scope of the invention. For example, due to codon redundancy, changes can be made in the underlying DNA sequence without affecting the protein sequence. Moreover, due to biological functional equivalency considerations, changes can be made in protein structure without affecting the biological action in kind or amount. All such modifications are intended to be included within the scope of the appended claims.

Method to Produce a Deletion Library

Figure 1:
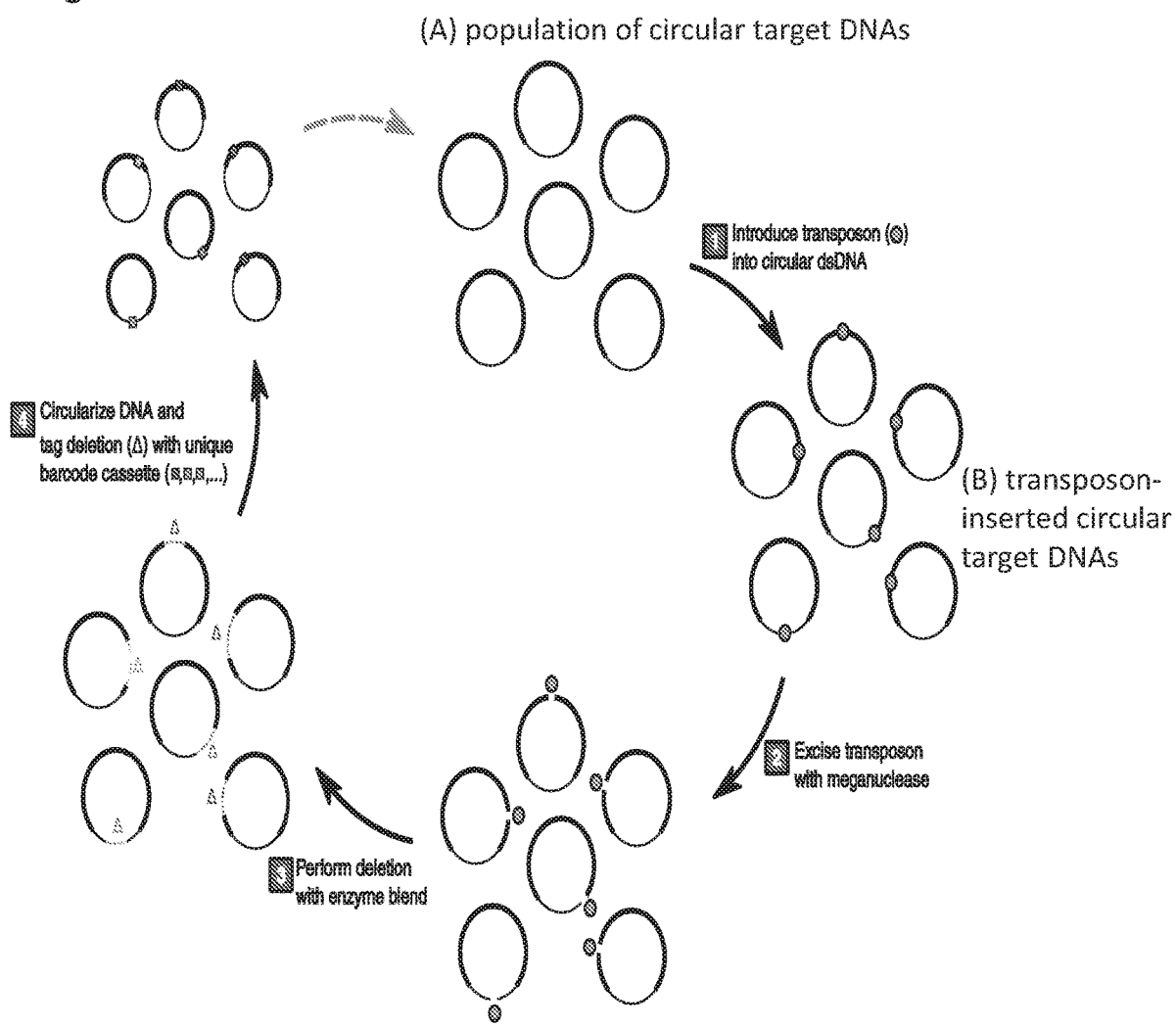
FIG. 1 provides a schematic representation of one embodiment of a method of generating a deletion library. The depicted use of a barcode to tag the deletion is optional.

The following examples demonstrate a high-throughput, molecular biology method, which used cycles of in vitro transposition and exonuclease digestion to generate random deletions in circular DNA (FIG. 1). The method allows control over the size of random deletions and optionally tags each member of the library with a molecular barcode to facilitate analysis by sequencing. The examples provided below demonstrate the generation of a library of tagged viral mutants. Performing multiple iterations of the cycle allows for the generation of multiply-deleted strains.

Materials and Methods (for Examples 1-5)

Determination of Minimal Conditions for Chewback Reactions (λ-HindIII Digest)

Chewback reactions were conducted in NEB Buffer 2.1 (New England Biolabs), the composition of which at 1× concentration is:

50 mM NaCl
10 mM Tris-Cl
10 mM MgCl2
100 ug/ml BSA
pH 7.9 @ 25° C.

λ DNA-HindIII digest, T4 DNA Polymerase (3 U/μl), RecJ$_f$ (30 U/μl), and ET SSB (500 ng/μl), were obtained from New England Biolabs. Template DNA, λ DNA-HindIII digest (New England Biolabs, #N3012S), was prepared for chewback by heating to 60° C. for 3 min and immediately cooling on wet ice prior to addition to the chewback reaction to separate annealed cohesive cos ends.

A standard 50 μl chewback reaction was prepared on wet ice in a 0.2 ml PCR tube by combining:

30.3 μl of dH$_2$O
5.0 μl of 10×NEB 2.1
10.0 μl of λ DNA-HindIII digest (500 ng/μl)
1.7 μl of T4 DNA Polymerase (3 U/μl)
0.5 μl of RecJ$_f$(30 U/μl)
0.5 μl of ET SSB (500 ng/μl)

The 50 μl reaction was immediately transferred from wet ice to a thermocycler (Bio-Rad) set to a block temperature of 37° C. and a heated lid temperature of 50° C., and incubated at 37° C. for 30 minutes to effect the double-strand chewback. After 30 minutes, 1 μl of 10 mM dNTPs was added (200 uM final dNTP concentration) and the reaction mixed and returned to 37° C. for 11 min to allow T4 DNA Polymerase to fill in recessed ends. After 11 minutes of fill-in, the reaction was halted by adding 2 μl of (500 mM EDTA, pH 8.0) to bring the EDTA concentration to 20 mM.

Figure 7:
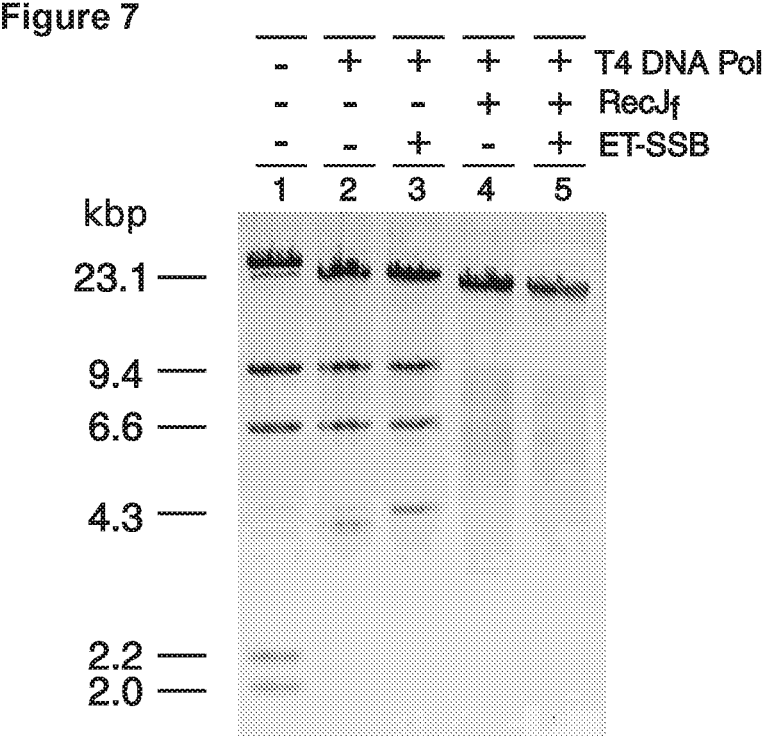
FIG. 7 provides data from contacting a population of cleaved linear target DNAs with T4 DNA polymerase (an example of a 3' to 5' exonuclease) to generate a population of deletion DNAs. The exonuclease digestion of the target DNAs using T4 DNA polymerase was performed in this example in the presence or absence of RecJ (a 5' to 3' exonuclease) and in the presence or absence of single strand binding protein (SSB).

For the various dropout reactions depicted in FIG. 7, dH$_2$O was substituted for enzyme solutions. Lane 1: 0 μl enzyme, Lane 2: 1.7 μl T4 DNA Pol, Lane 3: 1.7 μl T4 DNA Pol, 0.5 µl ET SSB, Lane 4: 1.7 µl T4 DNA Pol, 0.5 µl RecJ$_f$, Lane 5: 1.7 µl T4 DNA Pol, 0.5 µl RecJ, 0.5 µl ET SSB.

Determination of Chew-Back Rate

A ~4.3 kbp dsDNA template was obtained by purifying the 4361 bp fragment of λ DNA-HindIII digest. Ten µg of λ DNA-HindIII digest (New England Biolabs, #N3012S) were run out on a 0.8% low melting point agarose/TAE gel (Lonza SeaPlaque GTG agarose) and the gel stained for 20 minutes at 25° C. with SYBR Safe (Thermo Fisher Scientific) diluted to 1× concentration in TAE. DNA bands were visualized by placing the gel atop a blue light transilluminator (Lonza) and viewing the illuminated gel through UVEX S0360X blue light blocking safety glasses (Honeywell). Gel slices corresponding to the 4361 bp fragment were excised with a clean single-edge safety razor blade and transferred to tared microcentrifuge tubes. DNA was recovered by adding 0.1 gel volumes of 10× β-agarase I reaction buffer (New England Biolabs), melting gel slices briefly at 65° C., cooling to 42° C., and immediately adding 1 U of β-agarase I per 100 µl of molten gel (New England Biolabs). The mixture was incubated at 42° C. for 60 min to release DNA bound in the agarose matrix. DNA was precipitated from the digested fraction of the agarase reaction by adding 0.1 volumes of 3 M sodium acetate, pH 5.4, and 2 reaction volumes of 2-propanol. After mixing, the reaction was spun at 20000×g for 15 minutes at 25° C., and the supernatant aspirated. The DNA pellet was washed once with 900 µl of 70% ethanol, allowed to air dry briefly, then dissolved in (10 mM Tris-Cl, pH 8.0; 0.1 mM EDTA, pH 8.0).

200 µl of 2×dNTP buffer were prepared by combining:
- 40 µl of 10×NEB 2.1 (2× final conc.)
- 8 µl of 10 mM dNTP (400 µM final conc.)
- 152 µl of dH$_2$O and stored on wet ice.

150 µl of Stop Buffer was prepared by combining
- 10 µl of 500 mM EDTA, pH 8.0 (33 mM final conc.)
- 140 µl of dH2O and stored at bench temperature (24 C).

A 50 µl chew-back reaction was prepared on wet ice in a 0.2 ml PCR by combining:
- 30.3 µl of dH$_2$O
- 5 µl of 10×NEB 2.1
- 12 µl of 4.3 kbp dsDNA from above (~25 ng/µl)
- 1.7 µl of T4 DNA Polymerase (3 U/µl)
- 0.5 µl of RecJf (30 U/µl)
- 0.5 µl of ET SSB (500 ng/µl)

The 50 µl reaction was immediately transferred to a thermocycler set to a block temperature of 37° C. and a lid temperature of 95° C. At (0, 5, 10, 15, 20, 25, 30, 40, 50, 60, 70, 80 min) post-transfer to 37° C., a 4 µl aliquot was removed and combined with 4 µl of 2×dNTP buffer. These 8 µl reactions were incubated at 37° C. for 11 minutes to allow T4 DNA Polymerase to fill in the single-stranded tails that remain uncleaved by RecJ$_f$. After 11 minutes of fill-in, the reaction was halted by adding 12 µl of Stop Buffer to bring the EDTA concentration to 20 mM. Reactions were incubated on wet ice after addition of 12 µl of Stop Buffer.

dsDNA concentration was determined by a fluorometric method (PicoGreen, Thermo Fisher Scientific). 5 µl of each reaction was added to 95 µl of TE 10/1, pH 7.5. To this, 100 µl of a PicoGreen working stock (diluted to 1/200× in TE 10/1) were added in an Opti-F (Perkin Elmer) plate and read with an Enspire plate reader (Perkin Elmer) with 480 nm excitation and 520 emission filter, and fluorescence compared to a λ DNA standard. All reactions were performed in triplicate.

Chewback rates at 37° C. were calculated by fitting the decay in dsDNA (fluoresence signal) at various timepoints to a linear regression model with the freely-available R statistical software. Chewback rates were determined to be ~60 bp/min for 0-20 min and ~50 bp/min for 0-80 min.

Production of Transposon Insertion Library

Linear transposon cassettes were constructed by PCR from pTN5MK plasmid template. Oligos oTN5-F (5'-ctgtctcttatacacatctgcggccgc-3') (SEQ ID NO: 15) and oTN5-R (5'-ctgtctcttatacacatctgcggccgc-3') (SEQ ID NO: 16) were ordered with covalent 5'-phosphorylation modification and standard desalting purification from Integrated DNA Technologies. A 300 µl PCR master mix was prepared by mixing the following at bench temperature (24° C.):
- 60 µl of 5×Q5 Polymerase Buffer (New England Biolabs)
- 171 µl of dH$_2$O
- 6 µl of 10 mM dNTP
- 30 µl of 6 µM oTN5-F
- 30 µl of 6 µM oTN5-R
- 6 µl of pTN5MK (1 ng/µl)
- 3 µl of HotStart Q5 Polymerase (2 U/µl) (New England Biolabs)

The 300 µl PCR master mix was briefly mixed, then distributed as 6×50 µl aliquots in 0.2 ml PCR tubes. PCR was performed using the following program in a thermocycler with heated lid (105° C.):
- 1 cycle of 98° C. for 30 s
- 15 cycles of
  - 98° C. for 10 s
  - 68° C. for 20 s
  - 72° C. for 50 s
- 1 cycle of 72° C. for 300 s
- HOLD at 10° C.

Post-thermocycling, the 6×50 µl reactions were pooled and linear transposon DNA purified with the Zymo DCC-5 Kit (Zymo Research) across two DCC-5 silica columns per the manufacturer's instructions. The DNA was eluted from each column by adding 12 µl of (10 mM Tris-Cl pH 8.0; 0.1 mM EDTA, pH 8.0), and the two eluted fractions were pooled to obtain ~20 µl of purified transposon product. The concentration of linear DNA was determined to be ~75 ng/µl by absorbance at 260 nm using a Nanodrop spectrophotometer (Thermo Fisher Scientific).

The ~1.4 kbp linear transposon DNA was gel-purified by running out all 20 µl in a 2-cm wide well in a 0.8% agarose/TAE gel. Post-run, the gel was stained with 1×SYBR Safe (Thermo Fisher Scientific) in 1×TAE and a gel fragments corresponding to the 1.4 kbp linear transposon fragment excised upon illumination with a blue light transilluminator (Lonza) and viewed through UVEX S0360X blue light blocking safety glasses (Honeywell). DNA was recovered from the gel slice by adding 3 gel volumes of Buffer QG (Qiagen), and melting the gel slice by incubation at 37° C. with frequent mixing. The liquid gel mixture was applied to a DCC-5 silica column (Zymo Research) in repeated 600 µl volumes, interspersed by spinning the column at 10000×g for 40 seconds and discarding the flow-through. The DCC-5 column was washed twice by adding 600 µl of Wash Buffer (Zymo Research), spinning the column at 10000×g for 60 seconds, and discarding the flow-though. The column was carefully transferred to a 1.5 ml DNA LoBind tube (Eppendorf) and 30 µl of (10 mM Tris-Cl pH 8.0; 0.1 mM EDTA, pH 8.0) applied to the column bed and incubated for 1 minute. DNA was eluted by spinning the column for 1 minute at 10000×g. The concentration of linear DNA was found to be ~30 ng/µl by determining the absorbance at 260 nm using a Nanodrop spectrophotometer (Thermo Fisher Scientific).

An in vitro transposition reaction was performed using recombinant EZ-Tn5 transposase (Epicentre) (at a concentration of 1 U/µl in 50% glycerol containing 50 mM Tris-HCl (pH 7.5), 0.1 M NaCl, 0.1 mM EDTA, 1 mM dithiothreitol, and 0.1% Triton® X-100) and 10×EZ-Tn5 reaction buffer (Epicentre) (composition: 0.50 M Tris-acetate (pH 7.5), 1.5 M potassium acetate, 100 mM magnesium acetate, and 40 mM spermidine).

A 10 µl in vitro transposition reaction was assembled by combining the following in a 0.2 ml PCR tube:
2.0 µl of pNL4-3 (100 ng/µl) [14825 bp] [21.83 fmol]
2.0 µl of TN5MK gel-purified transposon (10 ng/µl) [1434 bp] [22 fmol]
1.0 µl of 10×EZ-Tn5 reaction buffer
4.0 µl of dH2O
1.0 µl of EZ-Tn5 transposase (1 U/µl)

The reaction was mixed and the 0.2 ml PCR tube transferred to a thermocycler set to a block temperature of 37° C. and a heated lid temperature of 50° C. for a 2 hour incubation. After a 2 hour incubation, 1 µl of 1% (m/v) SDS solution was added and the reaction heated to 70° C. for 10 min to halt the reaction.

After equilibrating to room temperature, the entire volume of the reaction was pipetted upon a 0.025 µm membrane (13 mm outer diameter) (Millipore, #VSWP01300), floating on 25 ml of TE 10/0.1, pH 8.0. Drop-dialysis was allowed to proceed for 1 hour to remove inhibitory salts from the reaction mixture. After 1 hour the reaction volume was recovered and placed in a DNA LoBind tube (Eppendorf) on ice.

1 µl of the reaction mixture (~10%) was added to 40 µl of ice-cold electrocompetent E. coli (strain DH10B), and introduced into a chilled 0.1-cm sterile cuvette (Bio-Rad) placed on wet ice. Bacteria were electroporated with a Gene Pulser II electroporation system (Bio-Rad) with pulse settings of 1.7 kV, 25 µF, 200Ω. Immediately post-electroporation, 960 µl of SOC (Thermo Fisher) were added and the cell mixture transferred to a sterile 15 ml polypropylene conical tube, and allowed to recover for 90 minutes at 30° C. After a 90 min recovery, 10 µl (1%) of the reaction was plated on one 10-cm plates containing solid media comprised of Lysogeny Broth supplemented with 1% agar, 100 µg/ml carbenicillin, and 50 µg/ml kanamycin (LBA+Carb$_{100}$+Kan$_{50}$). The remaining 99% of the transformation volume was plated across 6×10-cm LBA+Carb$_{100}$+Kan$_{50}$ plates. After incubation for 24 hours at 32° C., approximately 5000-10000 CFU were obtained across the six library plates. The bacteria were scraped from the agar surface using a sterile cell spreader after adding 5 ml of LB to each plate and recovered by centrifugation at 4000×g for 15 minutes. The bacterial pellet was resuspended in 6 ml of LB supplemented with 7% (v/v) DMSO and stored in 1.0 ml cryovials at −80° C. for future use.

Production of a Barcoded Deletion Library from an Insertion Library

One vial of the frozen insertion library (TN5MK in pNL4-3) was thawed and used to inoculate 500 ml of LB-Miller supplemented with 100 µg/ml carbenicillin and 50 µg/ml kanamycin (LBM+Carb$_{100}$+Kan$_{50}$) in a 2.8 L Fernbach flask. The culture was grown at 30° C. and 250 rpm in a shaking incubator (New Brunswick Scientific) until it reached an OD$_{600}$ of 1.0, whereupon a dry bacterial pellet was obtained by centrifugation and frozen at −80° C. Supercoiled plasmid DNA was obtained from the frozen bacterial pellet with a DNA Maxiprep Kit (Qiagen) per the manufacturer's instructions, and resuspended in TE 10/0.1 (10 mM Tris-Cl, pH 8.0; 0.1 mM EDTA, pH 8.0) at a concentration of >200 ng/µl.

Next, inserted transposons were excised from the plasmid insertion library to create linear DNA molecules by treatment with meganuclease I-SceI (New England Biolabs) in 1× CutSmart Buffer (New England Biolabs), whose 1× composition as specified by the manufacturer is (50 mM potassium acetate, 20 mM Tris-acetate, 10 mM magnesium acetate, 1 mM DTT, 100 µg/ml BSA, pH 7.9 at 25° C.), by the manufacturer (New England Biolabs). Approximately 50 µg of insertion library DNA were digested in a 500 µl reaction by mixing the following in DNA LoBind tube (Eppendorf):
105 µl of TN5MK in pNL4-3 (485 ng/µl)
50 µl of 10× CutSmart Buffer (New England Biolabs)
20 µl of I-SceI (5 U/µl)
335 µl of dH$_2$O The reaction was incubated for 8 hours at 37° C., with brief mixing by inversion performed every 2 hours. After 8 hours, the reaction was cooled to bench temperature (24° C.), then extracted once with 500 µl of 25:24:1 phenol:chloroform:isoamyl alcohol equilibrated with TE, pH 8.0 (Thermo Fisher Scientific) followed by a second extraction with 500 µl of pure chloroform (Sigma). The upper aqueous layer was transferred to a new DNA LoBind tube, and 1.0 µl (25 µg) of co-precipitating GenElute Linear Polyacrylamide (Sigma) was added and the solution mixed to homogeneity.

Digested DNA was precipitated from the aqueous phase by MgCl$_2$/PEG-8000 precipitation. The ~500 µl were adjusted to a final concentration of 12.5% (m/v) PEG-8000 and 20 mM MgCl$_2$ by adding 14 µl of 1 M MgCl$_2$ and 168 µl of 50% (m/v) PEG-8000. The reaction was inverted and flicked to mix, then spun at 20000×g for 60 min in a refrigerated microcentrifuge (Eppendorf) at 25° C. to pellet the precipitated DNA. After centrifugation, the pellet was difficult to visualize. The supernatant was removed and discarded and 900 µl of freshly-prepared 70% ethanol were added and the tube contents mixed by inverting the tube and flicking. Upon addition of 70% ethanol, the DNA pellet became readily visible. The tube was spun at 20000×g for 2 min to collect the pellet and the supernatant aspirated and discarded. An additional 900 µl of 70% ethanol were added to wash the pellet, and the tube spun again at 20000×g for 2 min to collect the pellet. All supernatant was carefully removed and the pellet dried briefly at room temperature (5 min) until no visible liquid remained. The DNA was solubilized by adding 60 µl of TE 10/0.1, heating to 42° C. for 20 minutes and mixed by flicking the tube. The concentration of linear DNA was found to be ~750 ng/µl by a fluorometric assay (Quant-iT™ PicoGreen® dsDNA Assay Kit from Thermo Fisher Scientific). DNA was stored at 4° C. until future use.

Before the chewback reaction occurred, substrate DNA was heated to 60° C. for 3 minutes and immediately placed on wet ice to separate DNA aggregates. Four standard chewback reactions (reactions R5, R10, R15, R20) were prepared on wet ice in four separate 0.2 ml PCR tubes. Each reaction was prepared by combining the following in a separate 0.2 ml PCR tube:
5.0 µl of 10×NEB 2.1
36.3 µl of dH$_2$O
6.0 µl of linearized pNL4-3/TN5MK insertion lib. (750 ng/µl)
1.7 µl of T4 DNA Polymerase (3 U/µl)
0.5 µl of RecJ$_f$ (30 U/µl)
0.5 µl of ET SSB (500 ng/µl)

All four 50 µl reactions were immediately transferred from wet ice to a thermocycler (Bio-Rad) set to a block temperature of 37° C., a heated lid temperature of 50° C., then incubated at 37° C. for a duration of 5-20 minutes to effect the double-strand chewback (R5: 5 min, R10: 10 min, R15: 15 min, R20: 20 min). At the appropriate time, the indicated reaction was removed from 37° C. incubation and 1 µl of 10 mM dNTPs were added (200 µM final dNTP concentration). The reaction was mixed and returned to 37° C. for 11 min to allow T4 DNA Polymerase to fill in recessed ends. After 11 minutes of fill in, the reaction was halted by adding 2 µl of (500 mM EDTA, pH 8.0) to adjust the EDTA concentration to 20 mM and placed on wet ice.

All four 50 µl chewback reactions (R5,R10,R15,R20) were pooled (200 µl volume) and then extracted once with 200 µl of 25:24:1 phenol:chloroform:isoamyl alcohol equilibrated with TE, pH 8.0, (Thermo Fisher Scientific). The ~200 µl upper aqueous layer was transferred to a new DNA LoBind tube (Eppendorf), and desalted by running 2×100 µl through separate Sephacryl gel filtration columns (Microspin S-400 HR columns (GE Lifesciences)).

The 2×100 µl flowthrough fractions were pooled and the linear DNA blunt-ended by NEBNext End Repair Reaction Module (New England Biolabs). The composition of the 1× End Repair Reaction buffer is specified by the manufacturer as: 50 mM Tris-HCl, 10 mM $MgCl_2$, 10 mM DTT, 1 mM ATP, 0.4 mM dATP, 0.4 mM dCTP, 0.4 mM dGTP, 0.4 mM dTTP, pH 7.5 at 25° C.). The enzyme mix contains a blend of T4 Polynucleotide Kinase (10 U/µl) and T4 DNA Polymerase (3 U/µl). A 400 µl end-repair reaction was prepared by combining the following in a DNA LoBind tube (Eppendorf) on wet ice:

200 µl of linearized deletion library (~20 µg total)
40 µl of 10× End Repair Buffer (NEB)
140 µl of $dH_2O$
20 µl of EndRepair Enzyme Mix (NEB)

The 400 µl reaction was distributed as 2×200 µl aliquots in 0.2 ml PCR tubes and incubated for 30 minutes in a thermocycler (Bio-Rad) with a block temperature set to 20° C.

After the 30 minute incubation, the 2×200 µl fractions were pooled and a single DNA LoBind tube (Eppendorf). The 400 µl pool was extracted once with 400 µl of 25:24:1 phenol:chloroform:isoamyl alcohol equilibrated with TE 10/1, pH 8.0, (Thermo Fisher Scientific), and once with 400 µl of pure chloroform (Sigma). The upper aqueous phase was transferred to a new DNA LoBind tube, and 1.0 µl (25 µg) of co-precipitating GenElute Linear Polyacrylamide (Sigma) was added and the solution mixed to homogeneity.

DNA was precipitated by $MgCl_2$/PEG-8000 precipitation. The remaining ~400 µl aqueous phase volume remaining was adjusted to a final concentration of 12.5% (m/v) PEG-8000 and 20 mM $MgCl_2$ by adding 13 µl of 1 M $MgCl_2$ and 135 µl of 50% (m/v) PEG-8000. The reaction was inverted and flicked to mix, then spun at 20000×g for 60 min in a refrigerated microcentrifuge (Eppendorf) at 25° C. to pellet the precipitated DNA. After centrifugation, the pellet was translucent and difficult to visualize. The supernatant was removed and discarded and 900 µl of freshly-prepared 70% ethanol were added and the tube mixed. Upon addition of 70% ethanol, the DNA pellet became white, opaque, and was readily visible. The tube was spun at 20000×g for 2 min to collect the pellet and the supernatant aspirated and discarded. An additional 900 µl of 70% ethanol were added to wash the pellet, and the tube spun at 20000×g for 2 min to collect the pellet. All supernatant was carefully removed and the pellet dried briefly at room temperature (5 min) until no visible liquid remained. The DNA was solubilized by adding 60 µl of TE 10/0.1, heating to 42° C. for 20 minutes and mixed by flicking the tube. The concentration of linear DNA was found to be ~200 ng/µl by determining the absorbance at 260 nm using a Nanodrop spectrophotometer (Thermo Fisher Scientific). DNA was stored at 4° C. until future use.

A 3'-dA overhang was added to the purified blunt-end barcode cassette with an a 3'→5' exonuclease deficient Klenow Fragment of *E. coli* DNA Polymerase I (New England Biolabs). Linear, end-repaired library DNA from above was heated for 3 minutes at 60° C., then immediately transferred to wet ice to cool. A 100 µl 3'-dA tailing reaction was prepared by mixing the following in a 0.2 ml PCR tube:

50 µl of end-repaired chewed-back library (~200 ng/µl)
10 µl of 10×NEB Buffer 2
32 µl of $dH_2O$
2 µl of 10 mM dTTP
6 µl of Klenow Fragment (exo-) (5 U/µl).

The 100 µl reaction was incubated for 1 h at 37° C. in a thermocycler (Bio-Rad) with a block temperature set to 37° C. and a heated lid temperature of 50° C. After the 1 h incubation, the enzyme was heat-inactivated by incubation at 70° C. for 20 minutes. The reaction was allowed to cool, and then 10 µl of 10× Antarctic Phosphatase Reaction Buffer (New England Biolabs) (1× composition: 50 mM Bis-Tris-Propane HCl, 1 mM $MgCl_2$, 0.1 mM $ZnCl_2$, pH 6.0 at 25° C.) were added to the tube and the contents mixed and pulsed down. Two pl of Antarctic Phosphatase (5 U/µl) (NEB) were added, the reaction mixed, then incubated for 1 h at 37° C. The enzyme was heat-inactivated by heating the reaction to 70° C. for 5 minutes.

Next, the 5'-dephosphorylated, >8 kbp 3'-dA tailed vector was purified from <8 kbp pieces of DNA (including the excised transposon cassette) by gel purification. Twenty µl of 6× Gel Loading Dye, Blue (New England Biolabs) (1× composition: 2.5% (m/v) Ficoll-400, 11 mM EDTA, 3.3 mM Tris-HCl, 0.017% (m/v) SDS, 0.015% (m/v) bromophenol blue, pH 8.0 at 25° C.) were added to 100 µl of 5'-dephosphorylated, 3'-dA tailed vector, and 12 µl of the mixture loaded in 10 wells of a 0.8% low melting point agarose/TAE gel (Lonza SeaPlaque GTG agarose) and run alongside a DNA ladder (Quick Load 1 kb extend ladder, NEB). The gel was run at 85 V for 90 minutes, until the bromophenol blue bands migrated to the middle of the gel, then stained for 30 minutes with SYBR Safe (gel stained for 20 minutes at 25° C. with SYBR Safe (Thermo Fisher Scientific) diluted to 1× concentration in TAE.

DNA bands were visualized by placing the gel atop a blue light transilluminator (Lonza) and viewing the illuminated gel through UVEX S0360X blue light blocking safety glasses (Honeywell). Gel slices corresponding to fragments of size between ~8-15 kbp were excised with a clean single-edge safety razor blade and transferred to tared microcentrifuge tubes. DNA was recovered by adding 0.1 gel volumes of 10× β-agarase I reaction buffer (New England Biolabs), melting gel slices briefly at 65° C., cooling to 42° C., and immediately adding 1 U of β-agarase I per 100 µl of molten gel (New England Biolabs). The mixture was incubated at 42° C. for 60 min to release DNA bound in the agarose matrix. DNA was precipitated from the digested fraction of the agarase reaction by adding 0.1 volumes of 3 M sodium acetate, pH 5.4, and 2 reaction volumes of 2-propanol. After mixing, the reaction was spun at 20000×g for 15 minutes at 25° C., and the supernatant aspirated. The DNA pellet was washed twice with 900 µl of 70% ethanol, allowed to air dry briefly, then dissolved in 40 µl of (10 mM Tris-Cl, pH 8.0; 0.1 mM EDTA, pH 8.0), and allowed to solubilize overnight at 4 C. The concentration of vector DNA was found to be ~150 ng/μl by determining the absorbance at 260 nm using a Nanodrop spectrophotometer (Thermo Fisher Scientific). A similar concentration (145 ng/μl) was determined by a fluorometric assay (Quant-iT™ PicoGreen® dsDNA Assay Kit from Thermo Fisher Scientific).

Blunt-end, 5'-phosphorylated, 60-bp barcode cassettes were prepared by PCR from ssDNA template. Oligonucleotides oBC20v1-F (5'-/5Phos/CCGTCCATGAAGGGTTC-GAT-3') (SEQ ID NO: 7) and oBC20v1-R (5'-/5Phos/ACGAATCTGCCGTTGCCATA-3') (SEQ ID NO: 8) were ordered with covalent 5'-phosphorylation modification and standard desalting purification from Integrated DNA Technologies. Oligonucleotide pool oBC20v1-T (5'-CCGTC-CATGAAGGGTTCGATNNNNNNNNNNNNNNNNNN-NNNTATGGCAACGGCAGATTCG T-3') (SEQ ID NO: 9), where N indicates (A,C,G,T) was ordered with machine-mixed bases and standard desalting purification from Integrated DNA Technologies.

Two aliquots of 1.1 ml of a PCR master mix was prepared by mixing the following at bench temperature (24° C.) in two DNA LoBind Tubes (Eppendorf):

550 μl of 2×Q5 HotStart HiFi Master Mix (New England Biolabs)
385 μl of dH$_2$O
27.5 μl of 20 μM oBC20v1-F (fwd oligo)
27.5 μl of 20 μM oBC20v1-R (rev oligo)
110.0 of 100 nM oBC20v1-T (template)

The 2×1.1 ml PCR master mixes were briefly mixed, then distributed as 40×50 μl aliquots in 0.2 ml PCR tubes. PCR was performed using the following program in a thermocycler with heated lid (105° C.):

1 cycle of 98° C. for 30 s
5 cycles of
98° C. for 10 s
65° C. for 75 s
1 cycle of 65° C. for 300 s
HOLD at 10° C.

Post-thermocycling, the 40×50 μl PCR reactions were pooled and the barcode cassette purified across ten DCC-5 columns using a DNA Clean and Concentrator 5 kit (Zymo Research) per the manufacturer's instructions. DNA was eluted from each of the ten silica DCC-5 columns with 15 μl of (TE 10/0.1, pH 8.0) and the five eluted fractions pooled to obtain ~150 μl of purified blunt-end barcode cassette. The concentration of blunt-end barcode cassette DNA was determined to be found to be ~26 ng/μl by a fluorimetric assay (Quant-iT™ PicoGreen® dsDNA Assay Kit from Thermo Fisher Scientific). The blunt-end barcode cassette was stored at −80° C. in a DNA LoBind tube (Eppendorf) for future use.

A 3'-dT overhang was added to the purified blunt-end barcode cassette with an a 3'→5' exonuclease deficient Klenow Fragment of *E. coli* DNA Polymerase I (New England Biolabs). A 300 μl reaction was prepared by mixing the following in a DNA LoBind tube (Eppendorf):

100 μl of blunt-end purified 60-bp barcode cassette (26 ng/μl)
30 μl of 10×NEB Buffer 2
146 μl of dH$_2$O
6 μl of 10 mM dTTP
18 μl of Klenow Fragment (exo-) (5 U/μl).

The 300 μl reaction was distributed across as 3×100 μl aliquots in 0.2 ml PCR tubes and incubated for 3 h in a thermocycler (Bio-Rad) with a block temperature set to 37° C. and a heated lid temperature of 50° C.

Post-incubation, the 3×100 μl PCR reactions were pooled and the 3'-dT barcode cassette purified with a single DCC-5 columns using a DNA Clean and Concentrator 5 kit (Zymo Research) per the manufacturer's instructions. DNA was eluted with 80 μl of (TE 10/0.1, pH 8.0). The concentration of the 3'-dT blunt-end barcode cassette DNA was determined to be found to be ~11 ng/μl by a fluorimetric assay (PicoGreen from Thermo Fisher Scientific). The 3'-dT barcode cassette was stored in 15 μl aliquots in DNA LoBind tubes (Eppendorf) at −80° C. in a DNA LoBind tube (Eppendorf) for future use.

Next, tailed barcode cassettes were ligated into the tailed vector and the DNA circularized using a Quick Ligation Kit (New England Biolabs). A 200 μl ligation reaction was prepared in a DNA LoBind tube by combining the following:

7.0 μl of tailed vector pNL4-3 (150 ng/μl)
10.5 μl of tailed barcode (11 ng/μl)
82.5 μl of dH2O
100.0 μl of 2× Quick Ligation Buffer
10 μl of Quick Ligase (T4 DNA Ligase at 2000 U/μl)

The reaction was incubated on benchtop (24° C.) for 2 hours to perform the ligation at a 30:1 insert:vector molar ratio. The reaction was halted by adding 8 μl of (500 mM EDTA, pH 8.0) and mixing. Next, 10 μl of Proteinase K (800 U/ml) (New England Biolabs) were added, the reaction mixed, then incubated for 30 min at 37° C. to cleave bound T4 DNA Ligase from the DNA.

During the 30 minute Proteinase K treatment, 65 μl of T4 PNK (New England Biolabs) Master Mix was prepared by combining the following:

6.5 μl of 10×T4 DNA Ligase Reaction Buffer
57.5 μl of dH2O
1.0 μl of T4 PNK (10 U/μl)

After 30 minutes, the reaction was purified with 1.8 reaction volumes (360 μl) of AMPure XP beads (Beckman-Coulter) per the manufacturer's direction, and eluted from the paramagnetic beads with 65 μl of the prepared T4 DNA Ligase master mix. The eluate was incubated at 37° C. for 60 min to phosphorylate DNA at the nicked sites.

After a 60 min incubation, the nicks were sealed by treatment with Taq DNA Ligase (New England Biolabs) in 1×Taq DNA Ligase Reaction Buffer (1× composition: 20 mM Tris-HCl, 25 mM potassium acetate, 10 mM magnesium acetate, 1 mM NAD+, 10 mM DTT, 0.1% (v/v) Triton X-100, pH 7.6 at 25° C.). A 100 μl reaction was prepared by combining the following in a 0.2 ml PCR tube:

60.0 μl of T4 DNA Ligase Reaction from above
10.0 μl of 10×Taq DNA Ligase Reaction Buffer
26.0 μl of dH$_2$O
4.0 μl of Taq DNA Ligase (40 U/μl)

The reaction was then introduced into a thermocycler (Bio-Rad) with block temperature of 50° C. and lid temperature of 75° C. for 15 minutes to seal nicks. Ligated DNA was purified from the ligations with 1.8 reaction volumes (180 μl) of AMPure XP beads per the manufacturer's instructions (Beckman Coulter Genomics), and eluted with 42 μl of TE 10/0.1, pH 8.0. The DNA was stored at 4° C. until use.

15 μl of the 40 μl of purified ligation (~30%) was electroporated into DH10B *E. coli*, in 15 separate transformation reactions. In each transformation, 1 μl of the library was added to 40 μl of ice-cold electrocompetent *E. coli* (strain DH10B), and introduced into a chilled 0.1-cm sterile cuvette (Bio-Rad) placed on wet ice. Bacteria were electroporated with a Gene Pulser II electroporation system (Bio-Rad) with pulse settings of 1.7 kV, 25 μF, 200Ω(time constant ~5 msec). Immediately post-electroporation, 960 μl of SOC (Thermo Fisher) were added and the cell mixture transferred to a sterile 15 ml polypropylene conical tube, and allowed to recover for 90 minutes at 30° C.

After a 90 min recovery, the 15×1.0 ml recovered transformations were pooled and mixed. One hundred microliters of the 15 ml pool was added to 900 µl of SOB, vortexed to mix, then 100 µl of this dilution (corresponding to 1/1500 of the library pool) plated on each of 6×10-cm plates of containing solid media comprised of LB-Miller supplemented with 1% agar and 100 µg/ml carbenicillin (LBMA+ $Carb_{100}$). The remaining 14.9 ml of the transformation was used to inoculate 500 ml of SOB+$Carb_{100}$ in a 2.8 L Fernbach flask and grown at 30° C. in a shaking incubator at 250 rpm for 24 h, until an OD600 of 3.0-4.0 was reached. The culture was chilled on wet ice and 450 ml of the 500 ml culture were harvested by centrifugation and used to prepare dry bacterial pellets for plasmid DNA isolation. The remaining 50 ml was spun down and resuspended in 14 ml of LB-Miller. To this 14 ml volume, 1.05 ml of pure DMSO (Corning) was added to adjust the concentration to 7% (v/v) DMSO. This solution was aliquoted to 15 sterile cryovials (Corning) and stored at −80° C. as seed stocks for the future library preparations.

The six plates had CFU counts of {69, 68, 73, 63, 79, 71}, avg of 70.5, which led to estimate of plated library size as 106,000 CFU (70.5×1500).

Sequencing of Plasmid Libraries

NGS libraries were prepared for paired-end sequencing on the Illumina HiSeq/MiSeq platforms. Separate sequencing libraries were prepared with a Nextera XT Kit (Illumina) from 1 ng of pNL4-3 insertion library and 1 ng of pNL4-3$\Delta_1$ deletion library. Transposon insertion and PCR enrichment were performed per the manufacturer's instructions, but the sublibraries were pooled and size-selected by running out on a 1.5% agarose gel, staining with 1×SYBR Safe (Thermo Fisher), and excising a gel fragment corresponding to DNA of size range of 350-500 bp. DNA was purified from the gel slice using Qiagen Buffer QG, Buffer PE (Qiagen), and DCC-5 columns (Zymo Research). The sublibraries were pooled and sequenced on a single lane of a HiSeq4000 (Illumina), using 2×125 b reads at the Center for Advanced Technology at University of California, San Francisco.

Transposon insertion locations were computed by filtering for reads containing an exact match of either mosaic end sequence of TN5MK, then extracting flanking regions to build an insertion map.

A lookup table matching deletion loci to barcode sequence was determined by 1) searching reads for the forward (oBC20v1-F (5'-CCGTCCATGAAGGGTTCGAT-3') (SEQ ID NO: 10)) and reverse (oBC20v1-R (5'-ACGAATCTGCCGTTGCCATA-3') (SEQ ID NO: 11)) common barcode sequences and extracting the intermediate 20 b; 2) assembling a list of barcode sequences; and 3) assigning flanking regions to each barcoded deletion using custom Python software.

High MOI Passage and Sequencing of an HIV-1 Deletion Library

Virus pool was obtained by co-transfection of HEK 293T with pNL4-3 (WT virus) and the pNL4-3 deletion library. On the day of transfection, a suspension of 293T was obtained by trypsinization of subconfluent 15-cm plates of 293T and brought into single cell suspension by gentle passage through a 40 µm mesh filter (Corning). A cell count was obtained with an automated cell counter (Moxi, ORFLO), and cells were diluted to a concentration of 5E5/ml in DMEM+10% FBS. Thirty-six ml of this culture (1.8E7 cells) was added to 3×T175 flasks. Next, 18 µg of pNL4-3, 18 µg of pNL4-3$\Delta_1$, and 108 µl of 1 µg/µl PEI were added to serum-free DMEM supplemented with 25 mM HEPES and the volume brought to 3.6 ml with extra serum-free DMEM w/25 mM HEPES, incubated for 15 minutes, then added to the upright flasks. The upright flasks were gently rocked, then lowered to a horizontal position in a 37 C/5% CO2 incubator. Media was replaced after an overnight incubation (16-20 h), and virus was harvested at 40-48 hours post-transfection by passing through 0.45 µm sterile filters (Millipore). Virus stocks were concentrated by ultracentrifugation. Twenty-five ml of clarified supernatant were underlaid with a 6% (m/v) iodixanol in DPBS-CMF in SW28 ultracentrifuge tubes, and then adjusted to 38.6 ml final volume with additional clarified supernatant. The tubes were spun for 90 min at 20000 rpm in an SW28 rotor at 4 C. Supernatant was decanted and the invisible viral pellets resuspended in pure heat-inactivated FBS and frozen at −80 C.

The virus pool was cultivated by high-MOI passage on MT-4, an HIV-permissive human T cell line. On day −1, virus stocks were titrated on 2E6 MT-4 in 6-well plates and cells were stained for intracellular p24 production at 24 hours post infection with a PE-labelled monoclonal antibody (KC57-RD1, BD). On day 0 (0 hours post infection (hpi)), 2E6 MT-4 were infected at an MOI of 5-20 with the virus pool containing WT HIV-1 and tagged HIV-1 deletion mutants for 4 hours in a volume of 2 ml, then transferred to a T25 flask containing 10 ml of MT-4 at a concentration of 1E6/ml. On day 2 (40 hpi), the 12 ml of culture was transferred to a T175 containing 60 ml of MT-4 at a concentration of 1 E6/ml. On day 3 (70-72 hpi), supernatant from the MT-4 was clarified by centrifugation and 0.45 µm filtration, and then concentrated by ultracentrifugation as described above. This cycle corresponds to 3 rounds of HIV-1 replication (completed on day 1, day 2, day 3). The cycle was repeated a total of four times (12 passages/rounds of replication) to select for deletion mutants that could be efficiently mobilized by HIV-1 in high MOI passage and retained all necessary cis-acting elements. The passage scheme was conducted with 3 biological replicates.

Viral RNA was isolated from frozen aliquots of the concentrated virus pool at various time points (passage 0, passage 3, passage 6, passage 9, passage 12) using a QIAmp Viral RNA Mini Kit (Qiagen) per the manufacturer's instructions with two exceptions: 1) carrier RNA was replaced with 5 µg of linear polyacrylamide (Sigma) per isolation 2) 5E6 copies of bacteriophage MS2 RNA (Roche) were spiked in per isolation.

Purified RNA was reverse-transcribed with Superscript III (Thermo Fisher) and Random Primer Mix (New England Biolabs). cDNA was used as template in real-time qPCR to quantitate barcode cassette concentrations with oligonucleotides oBC20v1-F (5'-/5Phos/CCGTCCATGAAGGGTTC-GAT-3') (SEQ ID NO: 12) and oBC20v1-R (5'-/5Phos/ACGAATCTGCCGTTGCCATA-3') (SEQ ID NO: 13), and compared to a standard curve prepared with dilutions of a barcode standard, oBC20v1-T (5'-CCGTCCAT-GAAGGGTTCGATNNNNNNNNNNNNNNNNNNNN-TATGGCAACGGCAGATTCG T-3') (SEQ ID NO: 14) in 10 µl reactions with Fast SYBR® Green Master Mix (Thermo Fisher). vRNA samples were not DNaseI-treated before reverse transcription, but DNA levels were acceptably low (−RT controls had barcode levels of <1/1000× of +RT reactions).

Illumina sequencing libraries were prepared by a modification of a method specified in Mandell2015 (Mandell et al, 2015 (doi:10.1038/nature14121)). Barcode cassettes were amplified from cDNA from above using a minimum number of cycles (typically 12-18) to prevent overamplification (post log-phase PCR) as evidenced by the RT-qPCR data from above. Illumina adaptors were added by two rounds of PCR (5 cycles each), to add phasing adaptors, random barcodes, and multiplexing barcodes. Sublibraries were size-selected on 5% TBE polyacrylamide gels and pooled for sequencing.

20-30 sublibraries were sequenced on two lanes of a HiSeq4000 (Illumina) (spiked with 25% PhiX), using a single 1×50 b reads at the Center for Advanced Technology at University of California, San Francisco.

Barcodes were tallied using custom Python software and matched to deletion loci using the lookup table prepared previously to calculate deletion depth.

Construction of Transposon Cassettes (TN5MC and TN5MK)

Transposon cassettes were ordered in 3 pieces as synthetic dsDNA (<500 bp) (gBlocks, Integrated DNA Technologies) and cloned by Gibson Assembly into pUC19 (linearized at the BamHI site). For the chloramphenicol-resistance transposon cassette (TN5MC), chloramphenicol-resistant pTN5MC transformants were selected on LB supplemented with 100 µg/ml carbenicillin and 33 µg/ml chloramphenicol at 37 C. For the kanamycin-resistance transposon cassette (TN5MK), kanamycin-resistant pTN5MK transformants were selected on LB supplemented with 100 µg/ml carbenicillin and 50 µg/ml kanamycin.

Example 1

Construction of an Insertion Library

Figure 2:
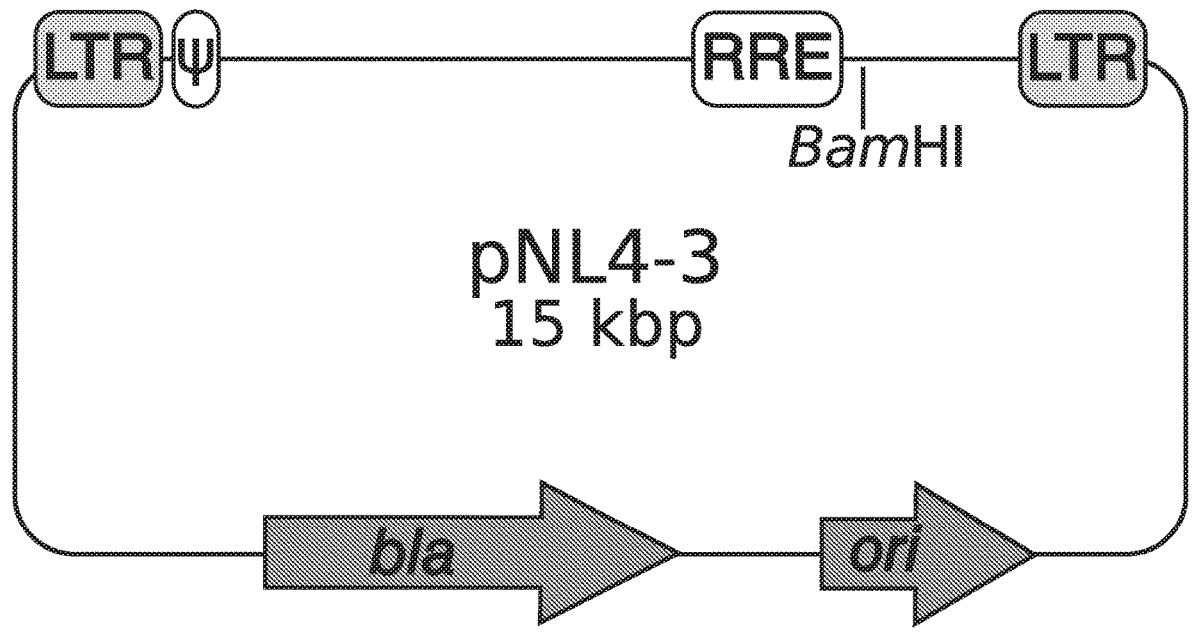
FIG. 2 provides a schematic representation of a circular target DNA that includes a wildtype viral genome, in this case the NL4-3 provirus of HIV-1.
Figure 3:
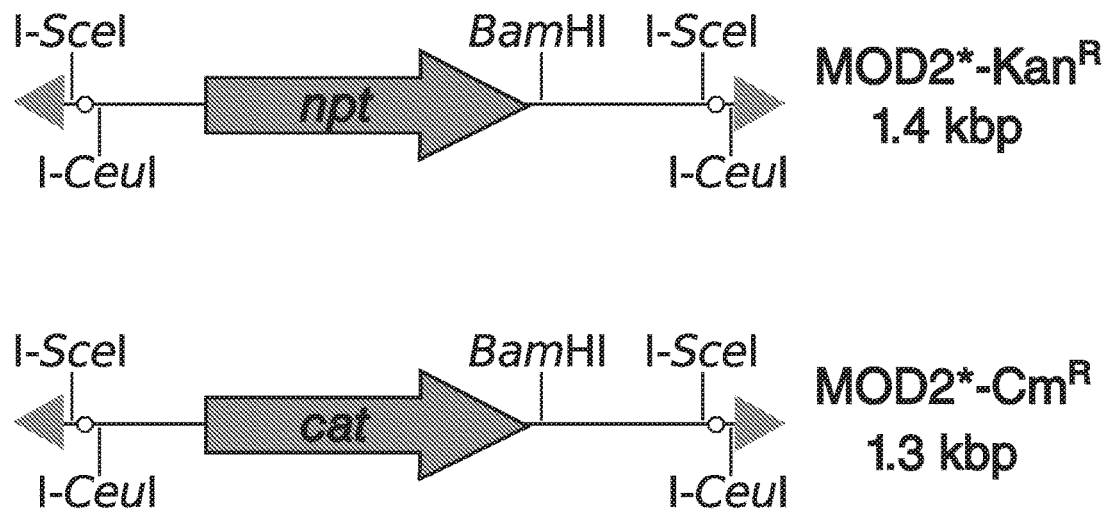
FIG. 3 provides a schematic representation of two examples of transposon cassettes that can be used in the subject methods. Note: "MOD2*-Kan$^R$" is referred to as "TN5MK" in FIG. 20 and "MOD2*-Cm$^R$" is referred to as "TN5MC" in FIG. 20.
Figure 4:
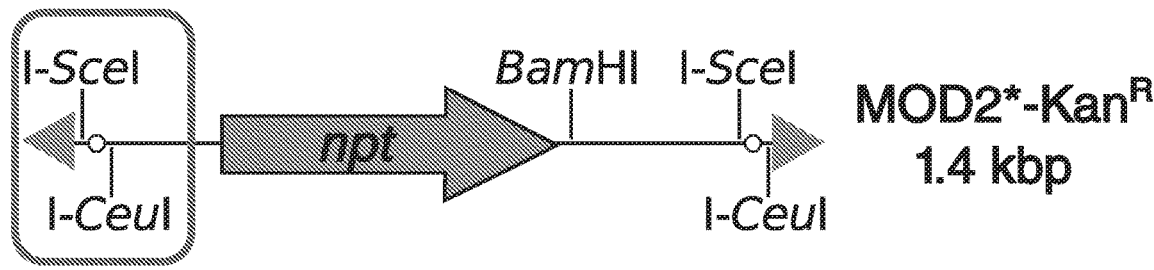
FIG. 4 provides sequence information for a portion of one example of a subject transposon cassette. The depicted stops codons, between the meganuclease recognition sequences, are an optional feature. Note: "MOD2*-Kan$^R$" is referred to as "TN5MK" in FIG. 20 (SEQ ID NOs: 163 and 164).
Figure 5:
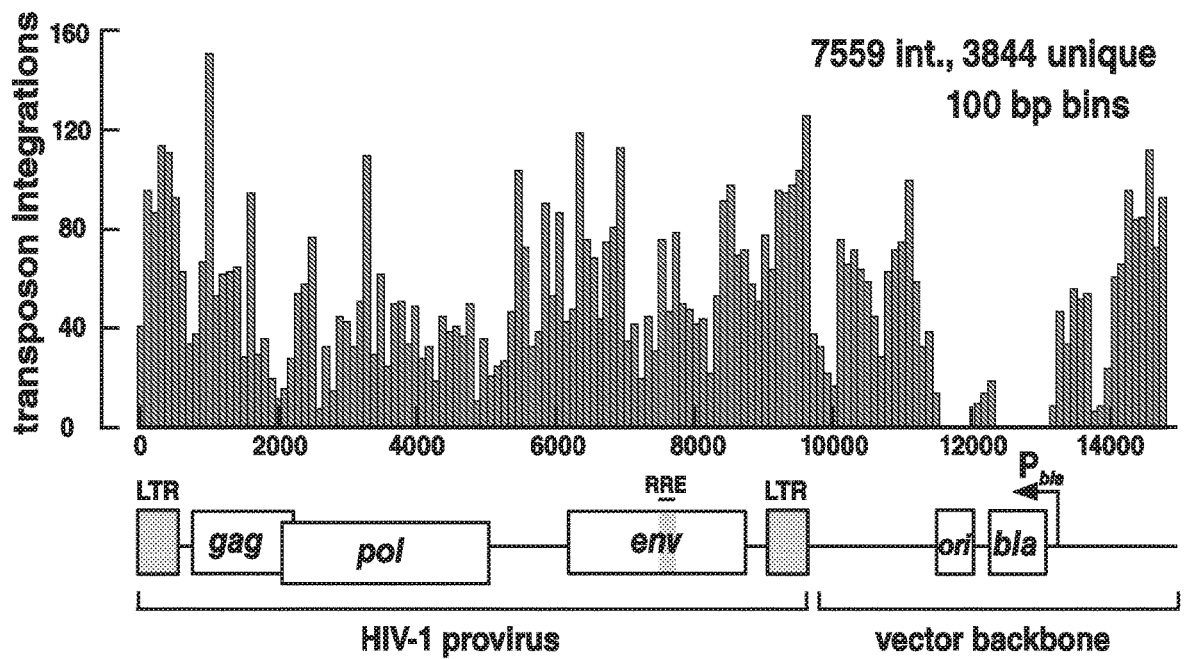
FIG. 5 depicts a plot of transposon insertion location vs genome position for transposon insertions (transposon-inserted circular target DNAs) generated using the methods disclosed herein.

The starting template was a population of circular target DNAs, in this case copies of the same plasmid, where the plasmid included sequence of a wildtype viral genome (FIG. 1, FIG. 2). A target sequence for a sequence specific DNA endonuclease, in this case recognition sequences for two meganuclease restriction sites, were introduced into the starting template via in vitro transposition with a modified Tn5 transposon and hyperactive Tn5 transposase (FIGS. 3-4). The custom transposon cassette harbored a drug-selectable marker ($Kan^R$ or $Cm^R$) flanked by meganuclease recognition sites I-SceI and I-CeuI (FIG. 3, FIG. 4, FIG. 20). E. coli were transformed with transposed DNA and insertion mutants were selected by plating on antibiotic-supplemented media. After recovery of the transposed DNA, the result was a population of plasmids, each containing a single transposon insertion, i.e., a population of transposon-inserted circular target DNAs. FIG. 5 depicts a plot of transposon insertion location vs genome position for transposon insertions (transposon-inserted circular target DNAs) generated using the methods disclosed herein. The data presented in this figure (obtained by deep-sequencing the transposon insertion library) show that transposons were integrated at a diversity of sites.

Example 2

Generation of Tagged Deletion Mutants

Figure 6:
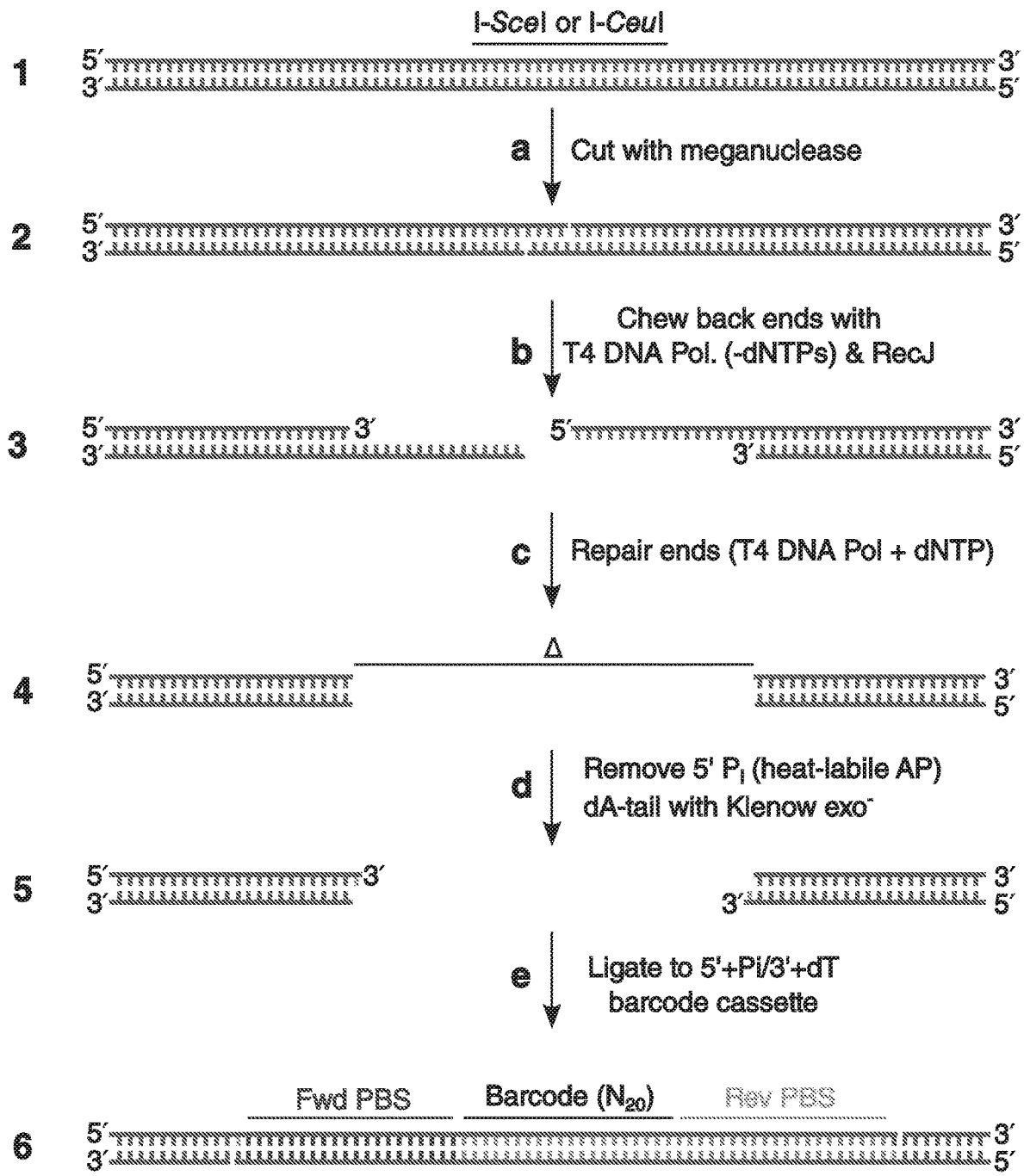
FIG. 6 provides a schematic representation of molecular details of steps of one embodiment of a method of generating a deletion library.
Figure 8:
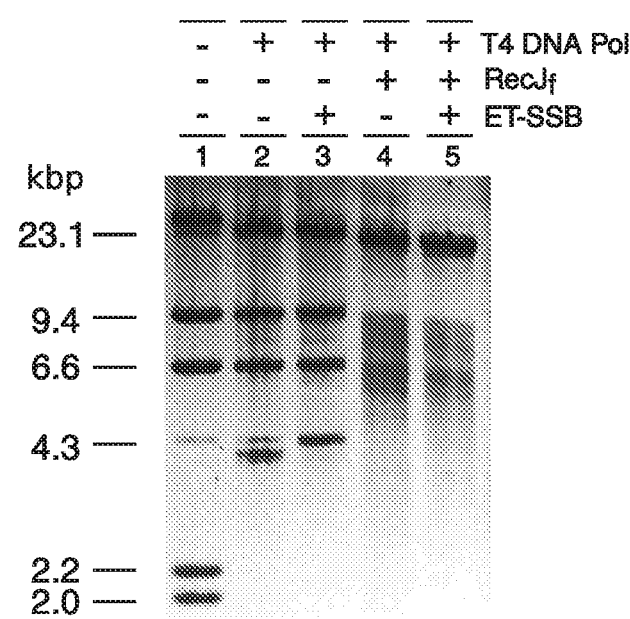
FIG. 8 provides the same data as FIG. 7, but the image is of a longer exposure.
Figure 9:
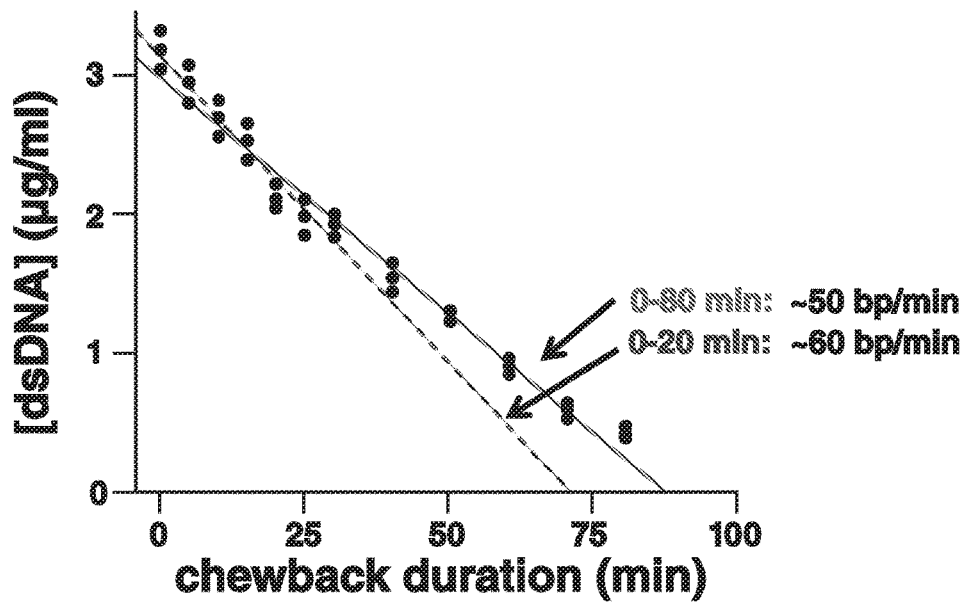
FIG. 9 provides a graph showing the amount of DNA removed during exonuclease digestion as a function of time.

Transposon-inserted DNA was digested with I-SceI or I-CeuI, liberating the inserted transposon cassette and generating a linearized molecular clone (FIG. 6). Deletions were performed in a one-pot reaction by treating linearized DNA with a mixture of three enzymes: T4 DNA Polymerase (a 3′→45′ exonuclease without dNTPs), RecJ (a 5′→43′ exonuclease) and single-strand binding protein (SSB) (FIG. 6, FIG. 7, FIG. 8). Here, the double-end chew-back rate proceeded at a rate of 50 bp/min at 37° C. and at a reduced rate at lower temperatures (FIG. 9). Thus, modulating the duration and temperature of the chewback reaction allowed for control of deletion size.

Vector DNA ends were blunted, dephosphorylated, and modified by a single 3'-dA overhang (FIG. 6). The vector was recirculated by ligation to a 3'-dT-tailed barcode cassette drawn from a pool of random barcode cassettes (a 60 bp cassette including 20 bp random barcode flanked by 20 bp primer binding sites) (FIG. 6). The nicked hemiligation product was sealed and transformed into the host bacteria. In this way, each deletion mutant was tagged with a unique barcode cassette with high probability.

Example 3

Sequencing to Map Barcodes to Deletion Loci

Figure 10:
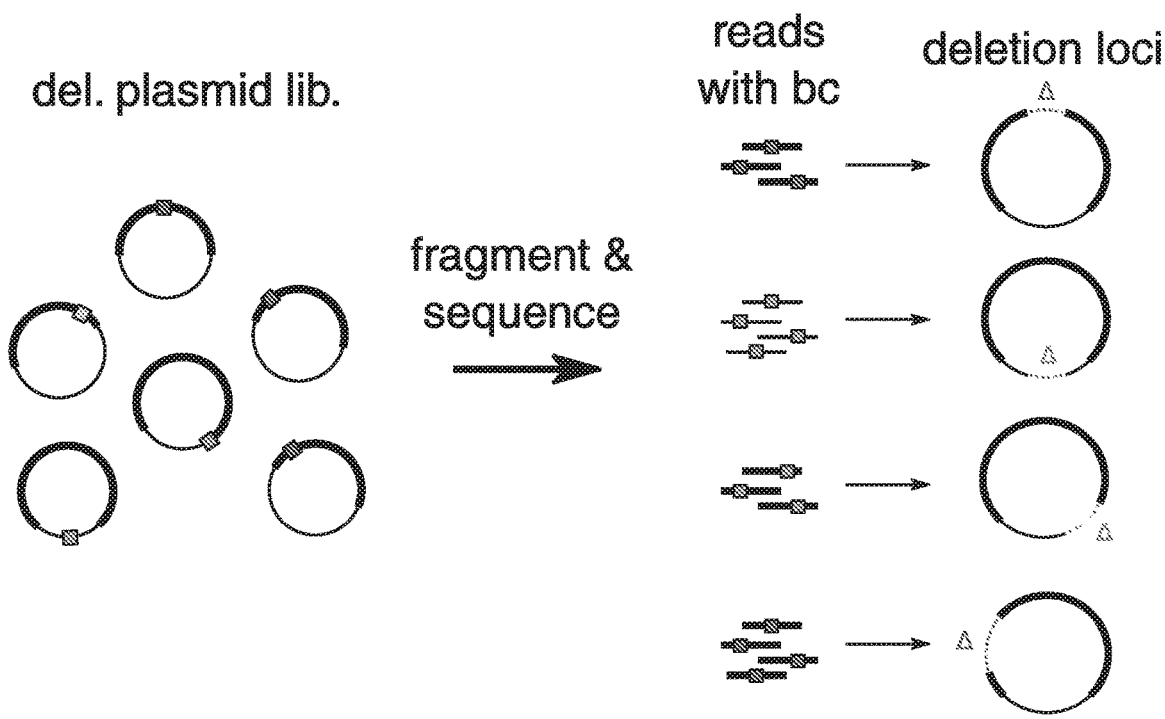
FIG. 10 provides a schematic representation of sequencing (e.g., deep-sequencing) members of a generated deletion library in which a barcode (e.g., barcode cassette) has been inserted.

The plasmid library was fragmented and deep-sequenced (e.g., 2×125 bp reads, HiSeq4000), and the results used to link barcode (bc) sequences to deletion sites (FIG. 10). The result was a lookup table mapping the set of barcodes ($B=\{b_1,b_2,b_3, \ldots \}$) to deletion loci ($D=d_1,d_2,d_3, \ldots$).

Each of the m deletion mutants is described as a sparse genotype bitvector m of dimensions (L×1), where $\underline{L}$ is the integer length of the undeleted wildtype sequence. Within the mutation bitvector m, 1's indicate that a base has been deleted and 0's indicate that a base has been retained. In general, deep sequencing the barcoded libraries, allows for computation of a count c, for each mutant by measuring the number of times a particular barcode is observed. The deletion depth vector d (the deletion depth profile) has dimensions (L×1) and is computed by multiplying genotype matrix M by count vector c, yielding (d=Mc). The genotype matrix M is a (0,1)-matrix of dimension L×m, while the count vector has dimensions (m×1). The genotype matrix M describes the genotypes of the barcoded mutants, where column i is the genotype bitvector of deletion mutant i. Within the count vector c, element i describes how many times the barcode associated with mutant i was observed.

FIG. 11 shows a histogram of deletion sizes that were generated when generating an HIV-1 deletion library (pNL4-3$\Delta_1$). As can be seen in the figure, a diverse range of different sized deletions were generated. FIG. 12 shows a plot of deletion depth that was obtained for the same library as FIG. 11. The plot demonstrates that the deletion library was comprehensive (coverage over the genome) and relatively unbiased. The valley surrounding ori/bla (required for plasmid maintenance in culture) shows that bacteria harboring plasmids with deletions in this region were select against.

Example 4

An Unbiased Procedure to Identify Essential Viral Cis-Acting Elements

Figure 13:
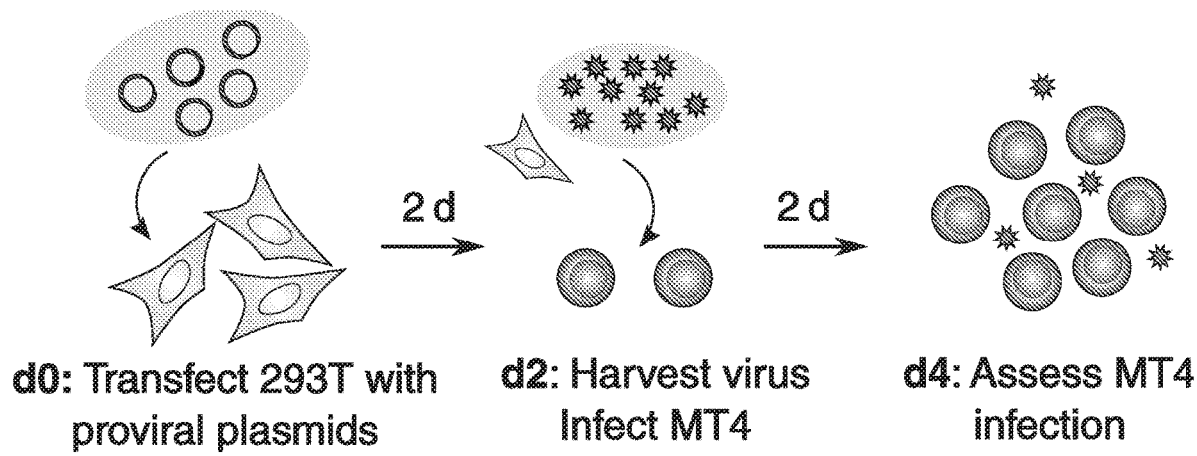
FIG. 13 provides a schematic representation of one method to test for infectivity of a generated deletion library where the circular target DNAs include a viral genome. For example, such a method may include a step of introducing members of the library of circularized deletion DNAs into cells, e.g., mammalian cells, and assaying for viral infectivity.
Figure 14:
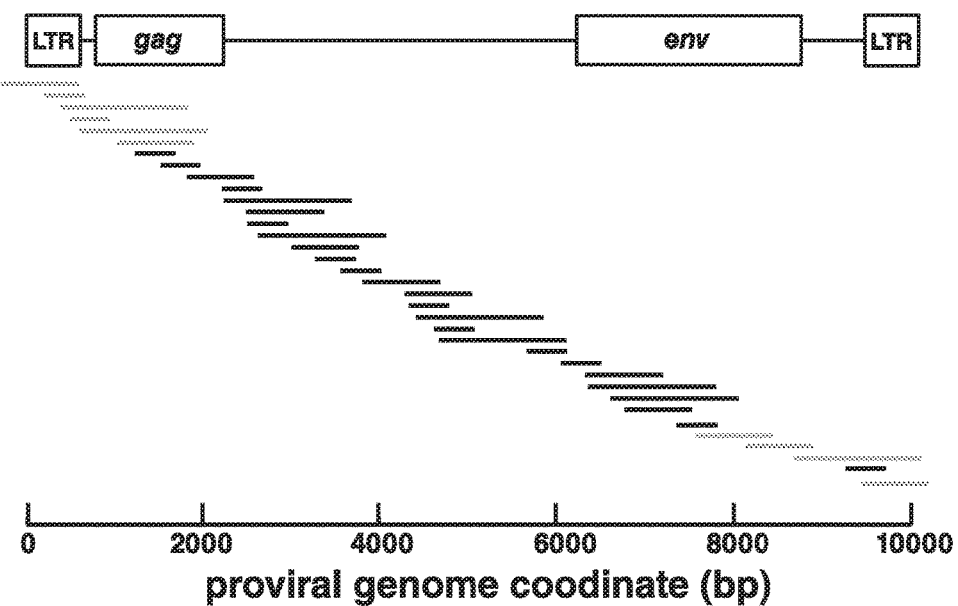
FIG. 14 provides a schematic representation of deletions that can be obtained in a generated library when the target DNA includes a viral genome.
Figure 15:
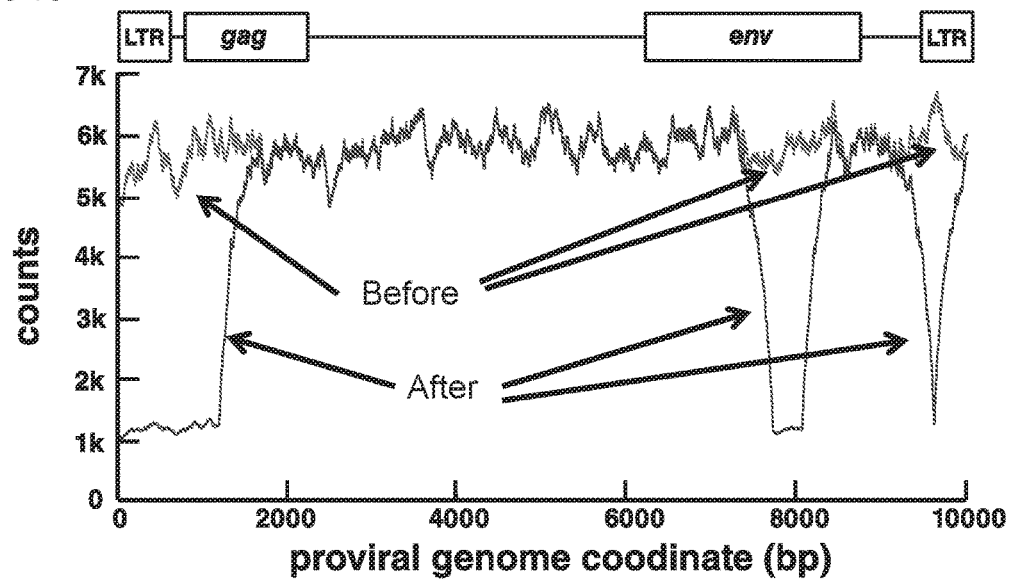
FIG. 15 provides a representation of the type of data that can be obtained using sequencing (e.g., to identify the presence of barcodes) before and after a step of assaying for viral infectivity.
Figure 16:
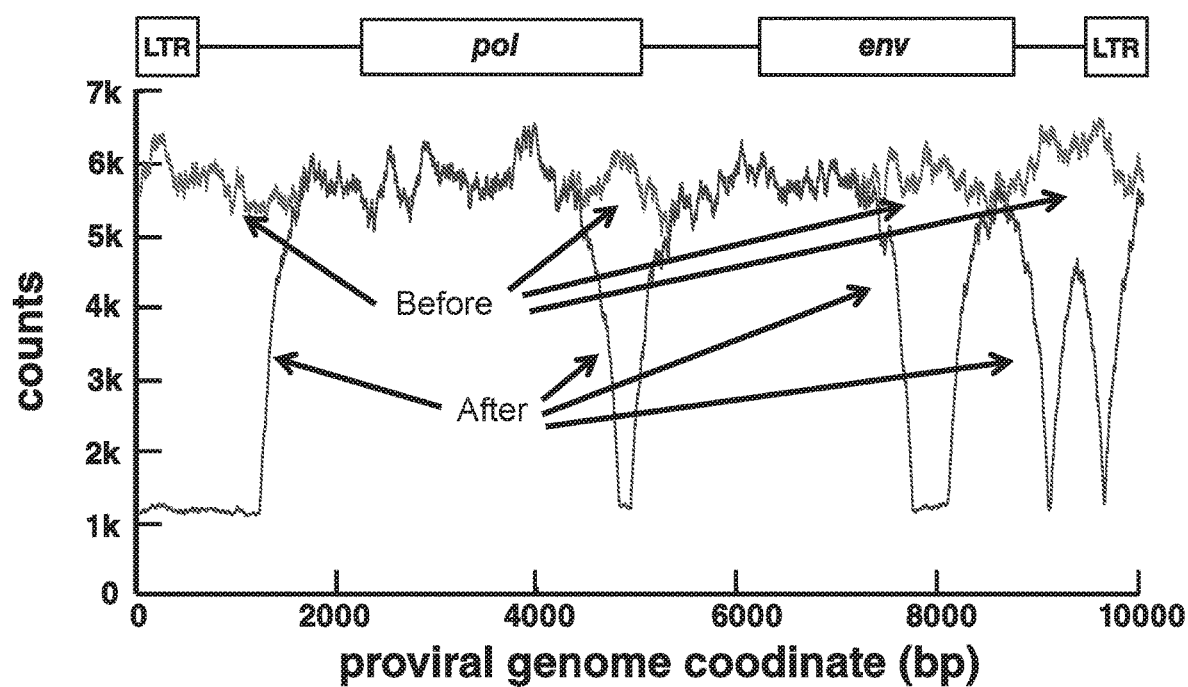
FIG. 16 provides a representation of the type of data that can be obtained using sequencing (e.g., to identify the presence of barcodes) before and after a step of assaying for viral infectivity.

In order to function as an effective TIP, a viral mutant retains the necessary cis-acting elements required for replication when complemented by the wildtype genome. The cis-acting elements of HIV-1 were mapped by producing virus from the deletion library (by transfection of the plasmid library into 293T) and using this virus pool to infect target cells at high multiplicity of infection (MOI) (FIG. 13). Sequencing of the barcodes at critical points in the infection cycle (transcription, encapsidation, reverse transcription, integration, etc.) and referencing the barcode/deletion lookup table allowed for the identification of regions where deletions were tolerated in each step of the HIV-1 replication cycle (FIG. 14). With high MOI infection, trans factors were provided by co-infection with replication-competent virus. Therefore, genome regions that can tolerate deletions (as measured by enrichment of deletion sites) correspond to trans-acting elements while regions that are intolerant of deletion correspond to cis-acting elements (FIG. 15, FIG. 16, FIG. 17, FIG. 18).

Example 5

Screening for TIPs by High- and Low-MOI Passage of Deletion Mutants

High multiplicity of infection (MOI) passage of viruses is a method to generate defective interfering particles/therapeutic interfering particles. Here cells are infected by more than one virus, which allows for complementation of defective viruses by wildtype counterparts.

Figure 17:
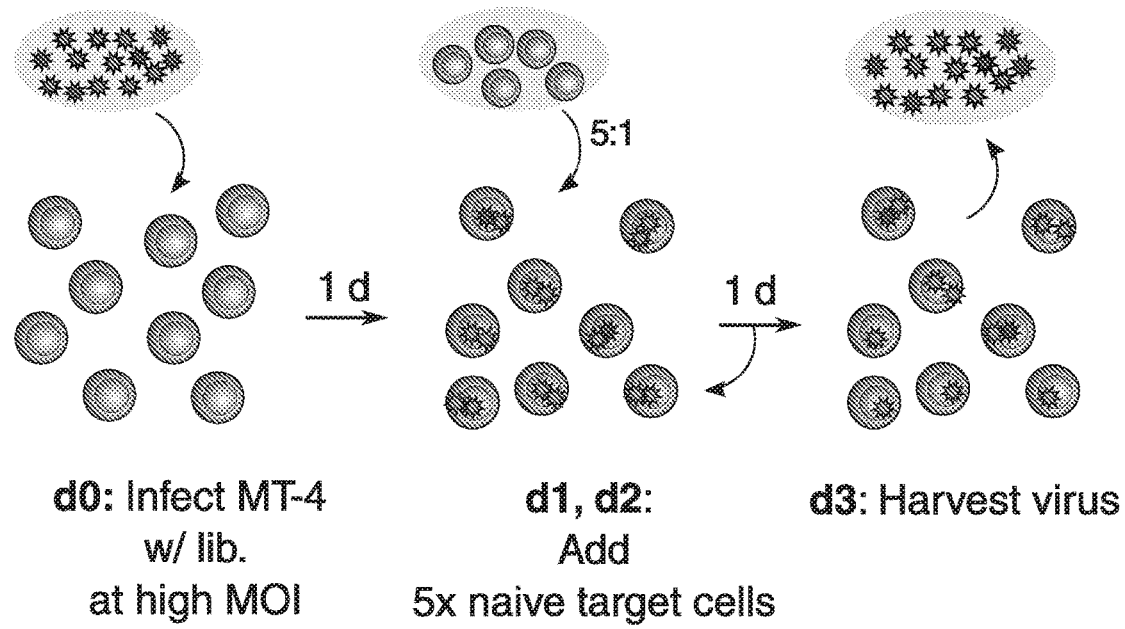
FIG. 17 provides a schematic representation of a "high multiplicity of infection (MOI) screen" for identifying DIPs from a generated deletion library of viral genome containing target DNAs. The indicated use of MT-4 cells is provided as an example and is not limiting.
Figure 18:
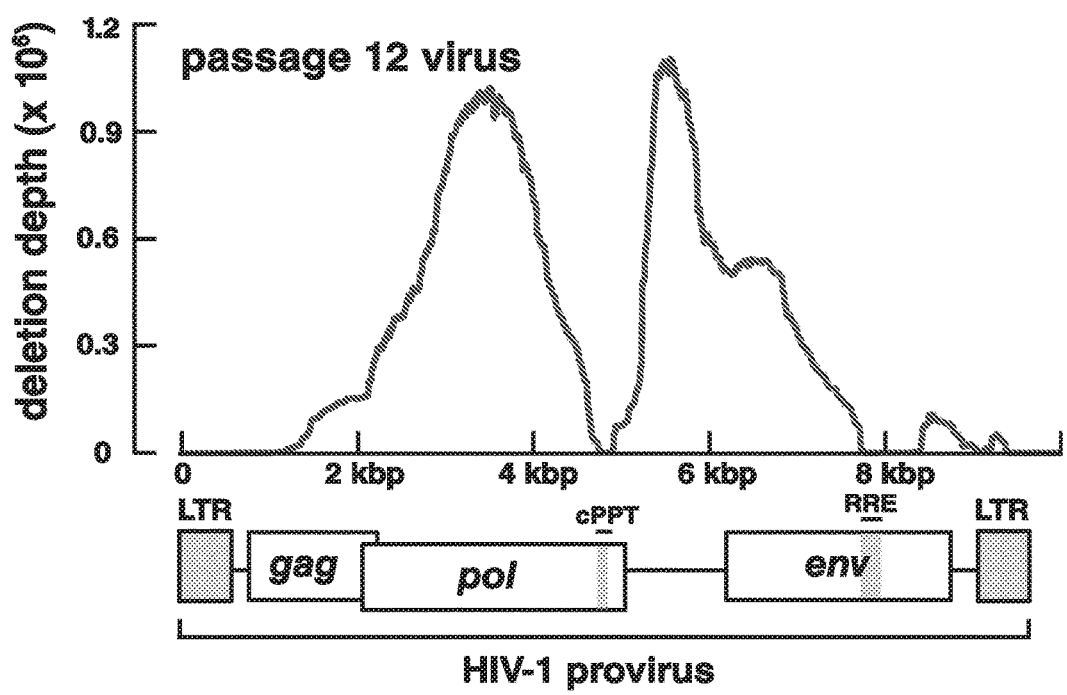
FIG. 18 presents a plot of deletion depth vs position for the NL4-3 library after 12 high-MOI passages in a T-cell line. High deletion depth indicates that deletions are tolerated in this region, low deletion depth indicates regions intolerant of deletion. This data is used to identify regions of the genome intolerant of deletion (cis-acting elements), where trans-complementation by the wildtype virus is not possible.

In this case, an HIV (NL4-3) viral deletion library was generated (i.e., the target DNAs included an HIV genome), and cells were then infected at high-MOI (MOI of 5-20). Repeated passaging of the deletion mutant libraries at high-MOI selected for mutants that could be mobilized effectively by HIV-1 (FIG. 17, FIG. 18). However, in some cases a method such as this may select for TIPs which can be mobilized effectively by the wildtype virus, but are cytopathic in the absence of the wildtype coinfection.

Figure 19:
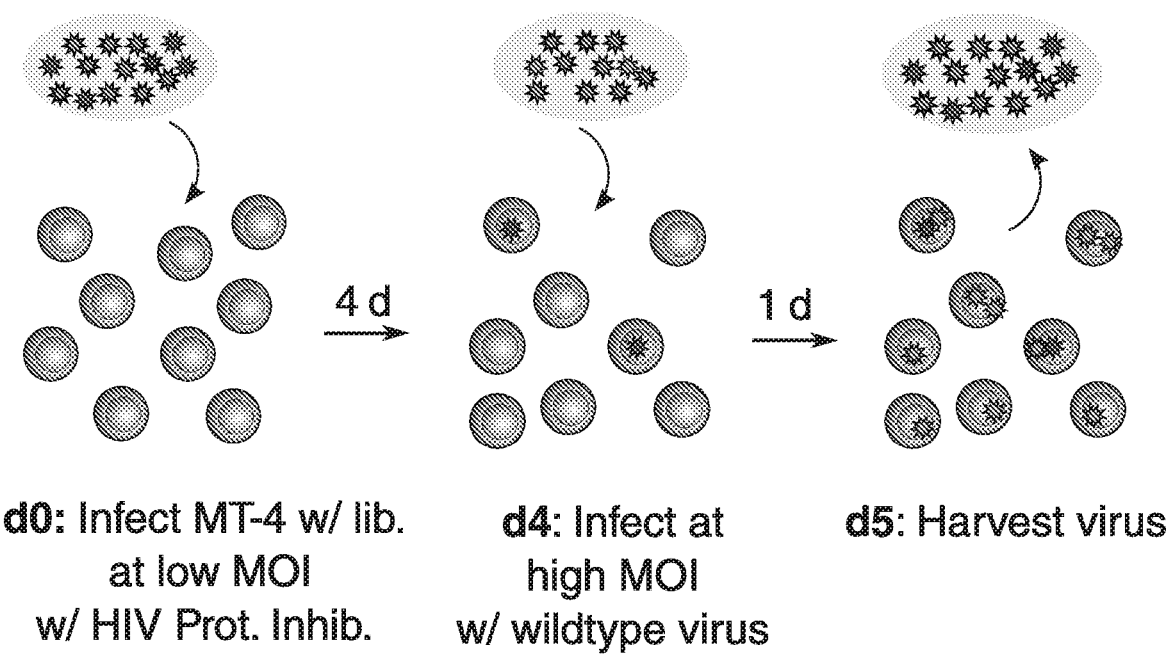
FIG. 19 provides a schematic representation of a "low multiplicity of infection (MOI) screen" for identifying DIPs from a generated deletion library of viral genome containing target DNAs. The indicated use of MT-4 cells and HIV protease inhibitors is provided as an example and is not limiting.
Figure 22:
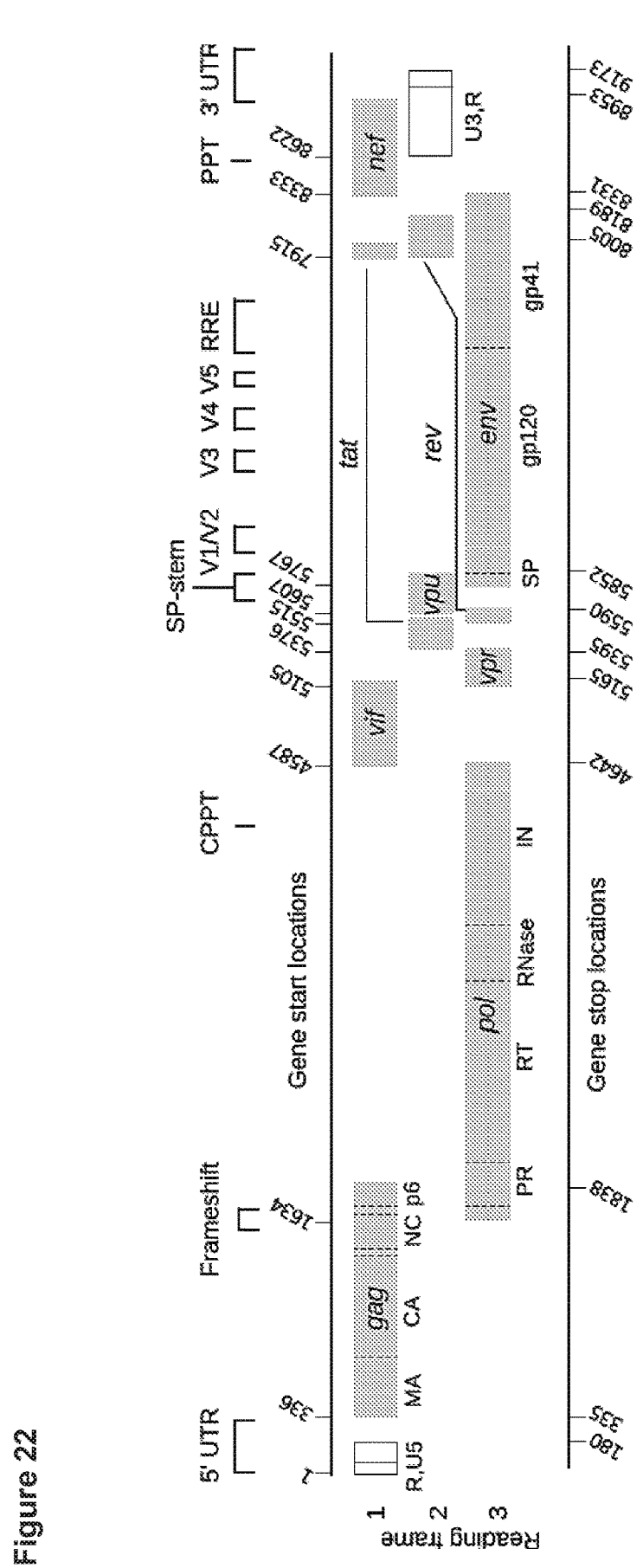
FIG. 22 provides a schematic showing the RNA genome of HIV-1. The nine protein coding genes of HIV-1 are depicted as gray rectangles, with protein domains annotated underneath each rectangle and protease cleavage sites shown as vertical dashed lines. Two of the genes are bi-exonic (tat and rev) while the remainder are mono-exonic. The LTR at the genome termini are shown as unfilled rectangles. Regions of known secondary structure and potential cis-acting elements are annotated above gene start locations and include: the 5' untranslated region, gag-pol ribosomal frameshift, central polypurine tract/central termination sequence, Env signal-peptide stem, V1, V2, V3, V4, V5 loops of gp120; the Rev Response Element; the polypurine tract; and the 3' UTR.

In a more stringent screen, low-MOI infection (MOI of <1) of target cells with tagged deletion libraries and high-MOI infection (MOI≥1) of the transduced population with wildtype virus (HIV-1) is alternated to mobilize TIPs to naive cells (FIG. 19). In between successive infections, the cells can be propagated in the presence of a drug to prevent further rounds of replication (e.g., Darunavir, an HIV-1 protease inhibitor). During this recovery period, HIV-1 infected cells will be killed, but cells transduced by well-behaving mutants (which do not produce cell-killing transfactors) will be maintained. In this fashion, mutants can be selected for which do not kill their transduced host-cell but can mobilized during wildtype virus coinfection.

In both screens, the profile of deletion loci are monitored by their deletion barcodes (lineage tracking) and the fittest strains can be isolated (or cloned, synthesized) and characterized.

Example 6

High-MOI Screen of an HIV-1 Random-Deletion Library

This Example demonstrates how a viral pool produced from a plasmid random deletion library can be screened for cis and trans-acting elements by high-MOI passage, and how to identify deletion mutants that are not replication-competent, but can be mobilized by the wildtype virus. Thus from first principles, cis- and trans-acting elements of viruses can be identified as well as transmissible antivirals.
Materials and Methods
Cell Culture Methods
293T (synonyms: HEK 239T, 293tsA1609neo) were obtained from the American Type Culture Collection (ATCC, #CRL-3216). Adherent 293T were propagated in D10 media, comprised of Dulbecco's Modified Eagle's Medium (DMEM; Corning, #10-013-CV) supplemented to a final concentration of: 10% (v/v) heat-inactivated fetal bovine serum (FBS) (Corning, #35-011-CV), 100 IU/ml penicillin & 100 µg/ml streptomycin (Corning, #35-002-CI), 25 mM HEPES (Thermo Fisher, #15630080), and 2 mM L-alanyl-L-glutamine (Corning, #25-015-CI). The cell line was cultivated in 15-cm polystyrene dishes in a humidified incubator at 37° C. with 5% $CO_2$. Subcultures were prepared by removing media, washing once with DPBS-CMF, treating with 0.25% Trypsin/2.21 mM EDTA in HBSS for 2-5 min at 37° C., then quenched by adding an equal volume of D10.

MT-4 cells (a $CD4^+$ T cell line) were obtained through the NIH AIDS Reagent Program, (Catalog #120). Cells were propagated in R10 media, comprised of Roswell Park Memorial Institute (RPMI-1640; Corning, #10-040-CV) supplemented to a final concentration of: 10% (v/v) heat-inactivated fetal bovine serum (FBS) (Corning, #35-011-CV), 100 IU/ml penicillin & 100 µg/ml streptomycin (Corning, #35-002-CI), 10 mM HEPES (Thermo Fisher, #15630080), and 2 mM L-alanyl-L-glutamine (Corning, #25-015-CI). The cell line was cultivated in sterile polystyrene T flasks within in a humidified incubator at 37° C. with 5% $CO_2$. Once established, cultures were maintained a density of $2 \cdot 10^6$-$2 \cdot 10^7$ cells per ml. Subcultures were prepared by diluting cultures with fresh R10 media to about $5 \cdot 10^6$ cells/ml every 2-3 days.
Production of Viral Stocks by Transfection of 293T A virus pool was obtained by co-transfection of 293T with pNL4-3 µplasmid (WT virus) and the pNL4-3 deletion library (pNL4-3$\Delta_1$) plasmid pool prepared above in Examples 1 and 2. On the day of transfection, a suspension of 293T was obtained by trypsinization of subconfluent 15-cm plates of 293T and brought into single cell suspension by gentle passage through a 40 µm nylon mesh filter (Corning #352340). A cell count was obtained with an automated Coulter cell counter (Moxi, ORFLO), and cells were diluted to a concentration of $5 \cdot 10^5$ cells/ml in D10. Thirty-six ml of this suspension ($1.8 \cdot 10^7$ cells) were added to 3×T175 flasks.

Next, 18 µg of pNL4-3, 18 µg of pNL4-3$\Delta_1$, and 108 µl of a 1 µg/µl polyethyleneimine (PEI) solution (prepared from 25 kDa linear PEI; Polysciences #23966-1) were added to serum-free DMEM supplemented with 25 mM HEPES and the volume brought to 3.6 ml with additional serum-free DMEM with 25 mM HEPES, incubated at bench temperature (24° C.) for 15 min, then added to the upright T175 flasks. The upright T175 flasks were gently rocked, then lowered to a horizontal position in a 37° C./5% $CO_2$ incubator. Media was replaced after an overnight incubation (range 16-20 h), and virus was harvested at 40-48 hours post-transfection by passing the virus-containing growth media through 0.45 µm sterile PVDF filters (Millipore, #SE1M003M00).

Virus stocks were concentrated by ultracentrifugation. Twenty-five ml of 0.45 µm filtered supernatant were underlaid with 5 ml of a 6% (m/v) iodixanol (Sigma #D1556) in DPBS (Calcium/Magnesium Free) solution in SW28 ultracentrifuge tubes (Beckman-Coulter #344058), then adjusted to a 38.5 ml final volume with additional 0.45 µm clarified filtrate. The tubes were spun for 90 min at 20,000 rpm in an SW28 rotor (Beckman-Coulter) at 4° C. The virus-depleted supernatant was decanted and the invisible viral pellets resuspended in pure heat-inactivated FBS and stored frozen in single-use aliquots at −80° C.

Titration of Viral Stocks

Infectious HIV-1 viral stocks were titrated by infecting cultures of MT-4 in 6-well plates with viral inocula and scoring for HIV p24-producing cells at 24 hours post-infection. HIV p24-producing cells included cells that are productively infected with wildtype HIV-1 and/or deletion mutants that are still competent to produce p24.

Briefly, 100 µl of HIV-1 inoculum was added to 1.0 ml of R10 containing $2 \cdot 10^6$ MT-4, mixed briefly, then incubated for 4 hours at 37° C. After four hours, an additional 1.0 ml of R10 was added and the infection was allowed to proceed for an additional 20 hours (a single-round of replication). At 24 hours post-infection, cultures were fixed by adding 0.1 volumes of 20% formaldehyde (tousimis #1008A) (final concentration 2.0%) and incubated for at least 1 hour at 4° C. to inactive infectious virus.

Figure 25:
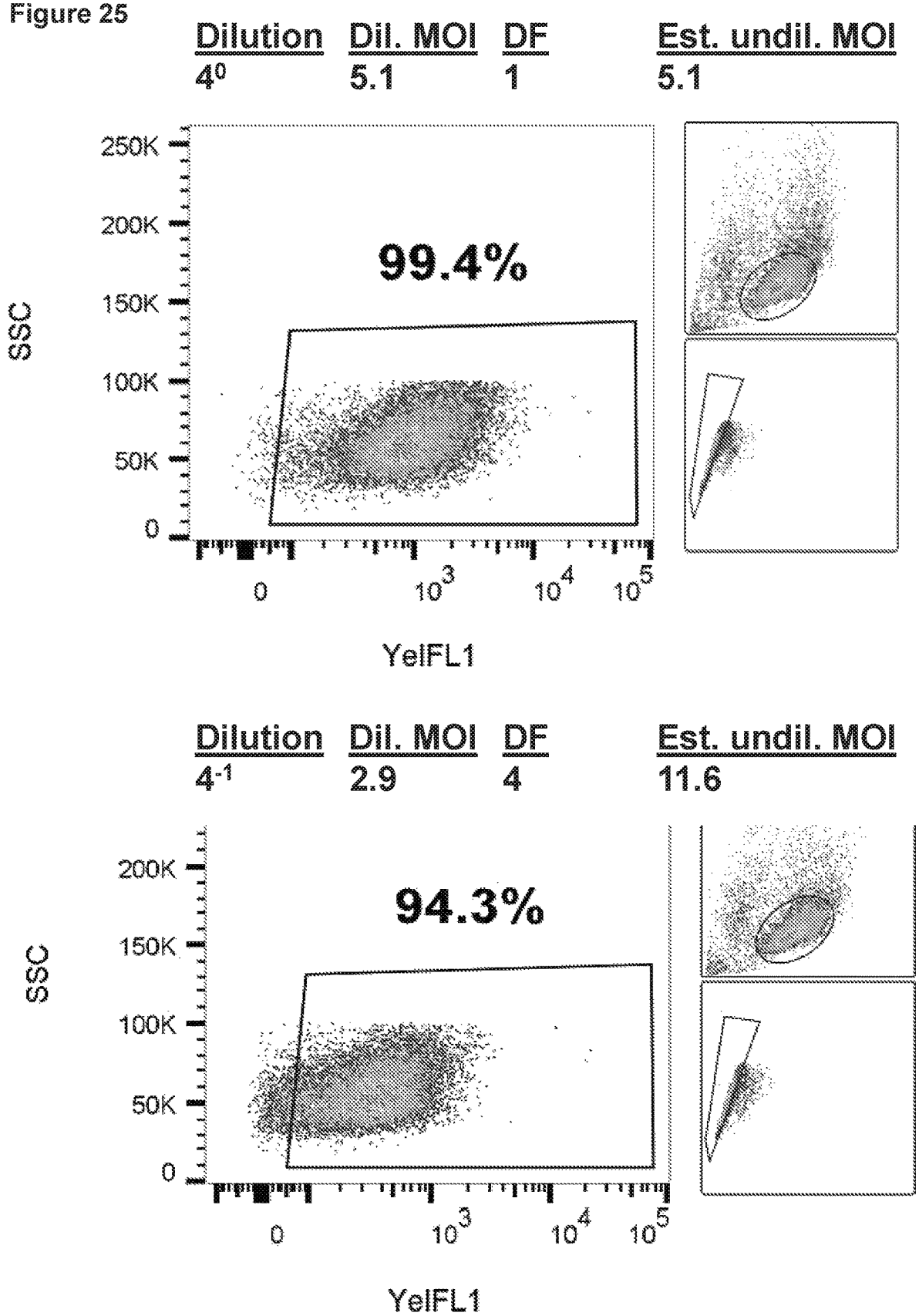
FIG. 25 provides flow cytometry dot plots illustrating an example titration of HIV-1 stocks in MT-4 cells according to an exemplary embodiment of the present disclosure (see also, Example 6). $2 \times 10^6$ MT-4 cells were infected with 100 μl of serial dilutions of an HIV-1 stock, and stained for HIV-1 Gag production (p24) at 24 hours post-infection, then assessed by flow cytometry. (DF: dilution factor, dil. MOI: MOI of dilution, est.: estimated). For each dilution, the largest flow cytometry dot plots depict side scatter (SSC) vs EGFP and the gating used to establish which cells are EGFP-positive; the small upper right plot depicts live cell gating (forward scatter (SSC) v SSC); the small lower right plot shows singlet gating (forward scatter width vs forward scatter area).

Formaldehyde-fixed cells were permeabilized by treatment with 75% ice-cold methanol for 10 minutes, then stained with a phycoerythrin-labelled monoclonal antibody against HIV-1 p24 (KC57-RD1, Beckman Coulter #6604667) in a staining buffer (DPBS-CMF+2% FBS+2 mM EDTA+0.1% IGEPAL-CA630) for 30 min before washing once in stain buffer without antibody. At least 50,000 live cells were counted by flow cytometry on a FACS Calibur DxP8. Gates were drawn based upon stained naïve cell population. A representative example is shown in FIG. 25.

Values are reported as IU/ml, where an IU (infectious unit) is the amount of virus needed to produce a p24+MT-4 cell at 24 hpi. As shown in FIG. 25, titers of concentrated HIV-1 stocks averaged $5 \cdot 10^7$ IU/ml.

High-MOI Passage of Virus Produced from a Random Deletion Library

A virus pool containing wildtype HIV-1 (NL4-3) and deletion mutants (NL4-3$\Delta_1$) was prepared by co-transfection of 293T with equal masses of the pNL4-3$\Delta_1$ library and the parental wildtype plasmid (pNL4-3) as described above. The virus-containing supernatant was collected, clarified by 0.45 µm filtration, then concentrated by ultracentrifugation at 48 hpi and titrated. The concentrated stock was used to infect MT-4 at high multiplicity of infection (>5) and passaged at high MOI (>5) as detailed below and in FIG. 26.

Figure 24:
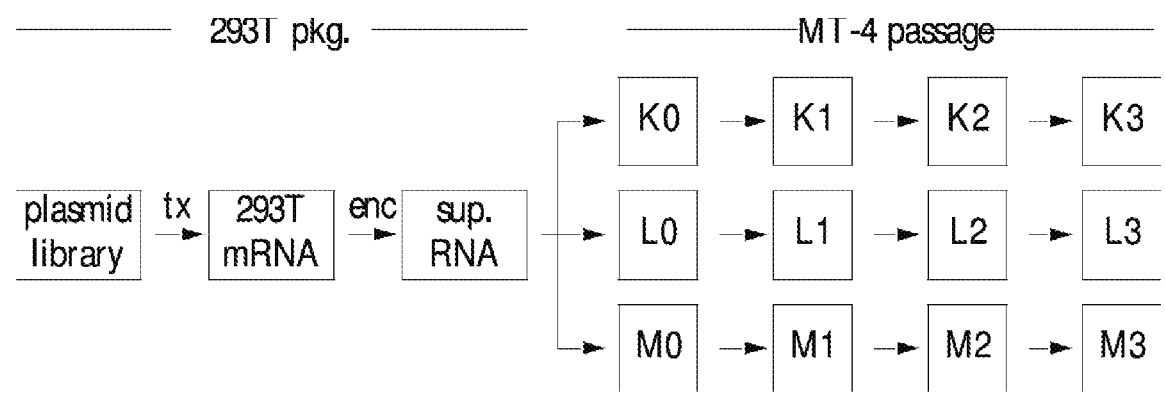
FIG. 24 provides a schematic of a block design of a high-MOI passage of NL43$\Delta_1$ according to an exemplary embodiment of the present disclosure (see also, Example 6). 293T cells were co-transfected with equal masses of pNL4-3 and pNL43$\Delta_1$ to generate a pool of infectious virus containing both wildtype virus and deletion mutants. The common virus pool was divided and used to infect MT-4 in triplicate (K,L,M). Using a combination of cell-mediated and cell-free transfers, cell-free virus was harvested after 1 week (3 passages: K0/L0/M0), 2 weeks (6 passages (K1/L1/M1)), 3 weeks (9 passages (K2/L2/M2), and 4 weeks (12 passages (K3/L3/M3).). In addition, samples of mRNA from 293T (tx: transcription) and cell-free supernatant (enc: encapsidation) were saved. At the same time, a pool of virus containing only NL4-3 (no deletion mutants) was passaged identically (Flasks A,B,C: not shown).

On day 0 (0 hpi), $2 \cdot 10^6$ MT-4 were infected at an MOI of 5-20 with the virus pool containing WT HIV-1 and tagged HIV-1 deletion mutants for 4 hours in a volume of 2 ml, then transferred to a T25 flask containing 10 ml of MT-4 at a concentration of $10^6$ cells/ml. On day 2 (40 hpi), the 12 ml of culture was transferred to a T175 flask containing 60 ml of MT-4 in R10 at a concentration of $10^6$ cells/ml. On day 3 (70-72 hpi), supernatant from the MT-4 was clarified by centrifugation and 0.45 µm filtration, and then concentrated by ultracentrifugation as described above. This cycle corresponds to 3 rounds of HIV-1 replication (completed on day 1, day 2, day 3). The cycle was repeated a total of four times (12 passages/rounds of replication) to select for deletion mutants that could be efficiently mobilized by HIV-1 in high MOI passage and retained all necessary cis-acting elements. The passage scheme was conducted with 3 biological replicates. A diagram of the passage scheme is shown in FIG. 24.

Virus stocks were titrated by infecting MT-4 and scoring for cells producing HIV Gag (p24) by flow cytometry.

Values are reported as IU/ml, where an IU (infectious unit) is the amount of virus needed to produce a p24+MT-4 cell at 24 hpi. As shown in FIG. 25, titers of concentrated stocks averaged $5 \cdot 10^7$ IU/ml.

Although viral stocks were of sufficient titer to provide good coverage of the library ($2 \cdot 10^6$ cells infected at an MOI of 5 yields $10^7$ infections), it was necessary to confirm that high MOI would be maintained in subsequent passages.

Figure 26:
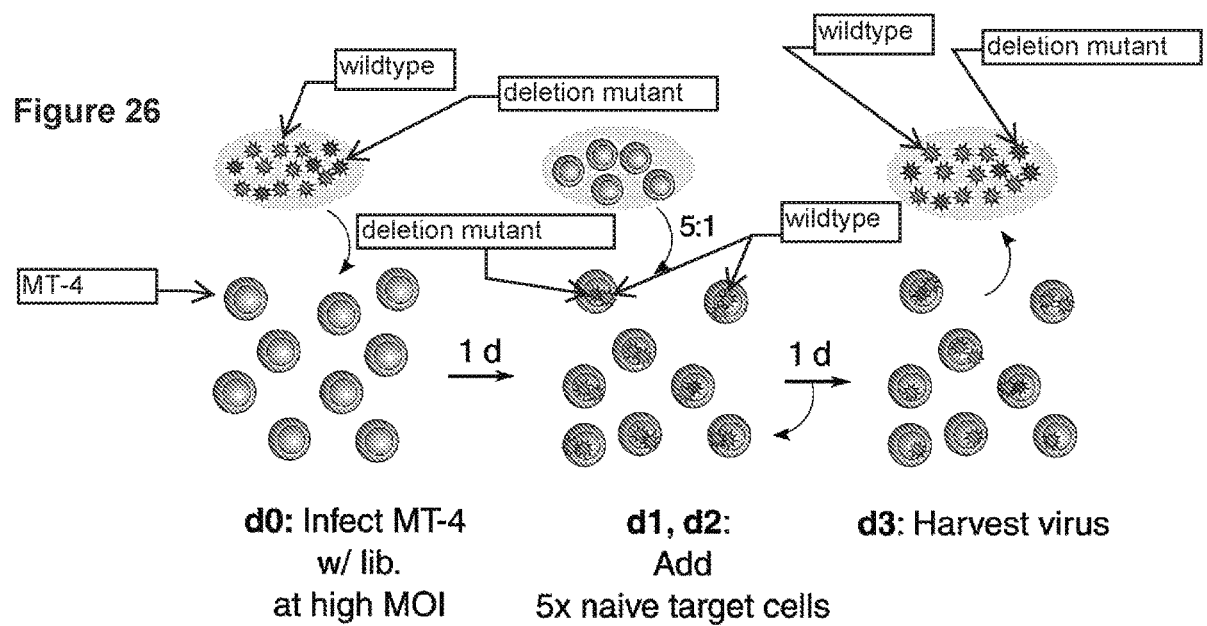
FIG. 26 provides a schematic of a HIV-1 high-MOI passage screen according to an exemplary embodiment of the present disclosure (see also, Example 6). On day 0, $2 \times 10^6$ MT-4 (blue double discs) are infected at high MOI with a pool of virus (HIV-1) containing both wildtype (red stars) and deletion mutants (blue stars). At day 1, $10^7$ additional naïve MT-4 are added and the volume expanded to 12 ml. On day 2, $6 \times 10^7$ additional naïve MT-4 were added and the volume expanded to 72 ml. On day 3, cell-free supernatant was harvested and virus purified by ultracentrifugation.
Figure 27:
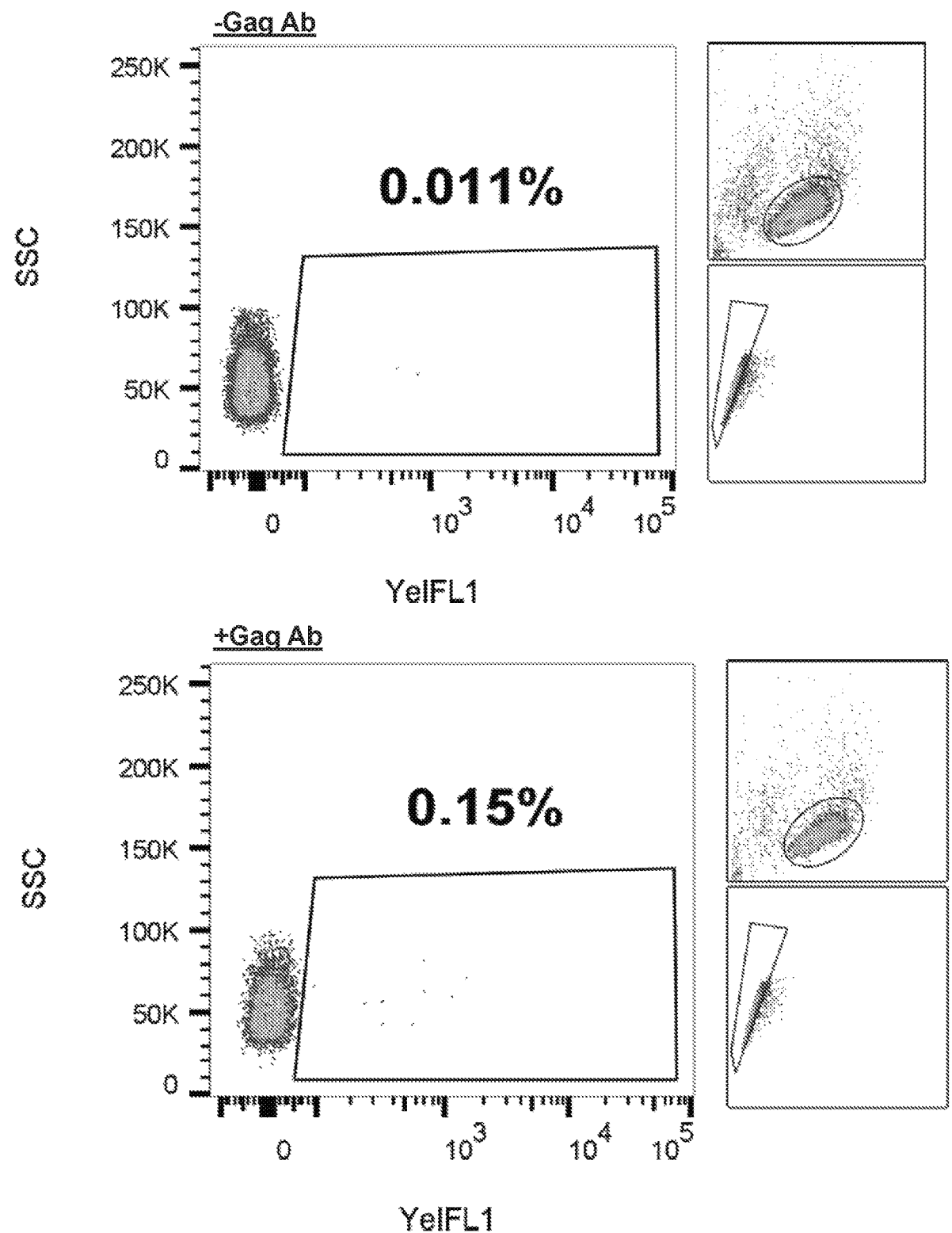
FIG. 27 provides flow cytometry dot plots showing that high MOI is maintained throughout a week of passage for an exemplary HIV-1 high-MOI passage screen (see also, Example 6). Cells that are positive for HIV-1 capsid protein are indicated in the polygonal gate and reported as percentage of the population. For each sample, the largest flow cytometry dot plots depict side scatter (SSC) vs EGFP and the gating used to establish which cells are EGFP-positive; the small upper right plot depicts live cell gating (forward scatter (SSC) v SSC); the small lower right plot shows singlet gating (forward scatter width vs forward scatter area).

In this scheme, shown in FIG. 26, virus can be transmitted by cell-to-cell and cell-free transfer. We confirmed that high MOI could be maintained by staining samples of cells for HIV p24 production throughout the passage. A representative example shown in FIG. 27 shows that >99% of cells were p24+ at various points in the transfer, indicating a high-MOI passage. These passage conditions were maintained throughout the passage scheme and the p24-staining procedure was repeated during each week of passage to confirm that high MOI passage conditions were maintained. The high MOI passage conditions select for two phenotypes of virus: (a) replication-competent viruses and (b) replication-defective viruses that are efficiently trans-complemented by wildtype virus (mobilized).

Isolation of vRNA and Quantitation of WT and Deletion Mutant Levels

Viral RNA was isolated from frozen aliquots of the concentrated virus pool at various time points (passage 0, passage 3, passage 6, passage 9, passage 12) using a QIAmp Viral RNA Mini Kit (Qiagen) per the manufacturer's instructions with two exceptions: (1) carrier RNA was replaced with 5 µg of linear polyacrylamide (Sigma #56575-1ML) per isolation (2) $5 \cdot 10^6$ copies of bacteriophage MS2 RNA (Roche, #10165948001) were spiked-in per isolation.

Total cellular RNA from 293T cells was isolated using Trizol (Life Technologies) from cell pellets obtained at the time of viral harvest. A poly(A) fraction, representing mRNA, was isolated by annealing total RNA to magnetic (dT)$_{25}$ beads to pull down polyadenylated transcripts using a commercial kit (NEBNext Poly(A) mRNA magnetic isolation module). Purified RNA was reverse-transcribed with Superscript III (Thermo Fisher) and Random Primer Mix (New England Biolabs). cDNA was used as template in real-time qPCR to quantitate barcode cassette concentrations with oligonucleotides oBC20v1-F (CCGTCCAT-GAAGGGTTCGAT) (SEQ ID NO:17) and oBC20v1-R (ACGAATCTGCCGTTGCCATA) (SEQ ID NO:18) and compared to a standard curve prepared with dilutions of a barcode standard, oBC20v1-T: CCGTCCAT-GAAGGGTTCGATNNNNNNNNNNNNNNNNNNNN-TATGGCAACGGCAGATTCG T (SEQ ID NO:19), in 10 µl reactions with Fast SYBR Green Master Mix (Thermo Fisher). Levels of total HIV RNA were estimated by levels of HIV pol with oligos oNL43pol-F (GA-GACAGGGCAAGAAACAGC) (SEQ ID NO:20) and oNL43pol-R (AACAGGCGGCCTTAACTGTA) (SEQ ID NO:21). Samples were normalized for recovery by determining levels of MS2 RNA recovered by oligos oMS2-F (TCCTGCTCAACTTCCTGTCGAG) (SEQ ID NO:22) and oMS2-R (CAGGTCAAACCTCCTAGGAATG) (SEQ ID NO:23) (sequences from (Vermeire, J. et al. *PLoS One*, 7, e50859 (2012)). Samples were not DNaseI-treated before reverse transcription, but levels of background DNA were acceptably low (−RT controls had barcode levels of <1/1000× of +RT reactions).

Viral RNA was purified from concentrated viral stocks and cell pellets at various points during the high MOI passage. During purification of viral RNA, $5 \cdot 10^6$ copies of a heterologous sequence (bacteriophage MS2) were spiked in to each purification to normalize recoveries and to serve as a normalization and recovery control.

Levels of barcode cassette (BC) and HIV-1 pol (POL) were determined by RT-qPCR. Genomes containing a tagged deletion will harbor BC and genomes that retain the wildtype pol sequence (all wildtype HIV and mutants that do not have a deletion in pol). Thus BC signal correlates with the concentration of tagged deletion mutants and POL as a measure of total viral genome concentration (provided that pol deletion mutants are in the minority). RT-qPCR data for supernatant concentrations are listed in Table 1 as quantification cycle ($C_q$) values. Higher values of $C_q$ indicate reduced abundance of a template molecule; lower values of $C_q$ indicate increase abundance and the scale is logarithmic in base 2, with a $\Delta C_q$ of 1 corresponding to an ≈2-fold difference and a $\Delta C_q$ of 3 corresponding to an ≈8-fold difference. Importantly, the BC primers form a stable primer dimer structure that is amplified even without the presence of template (no-template controls: NTC reactions). The limit of detection for BC is somewhere in the interval of $C_q$ 29-35. True primer dimers and true barcode samples can be differentiated by a melt-curve after cycle 40 of qPCR.

Results

The results of the RT-qPCR analysis are provided in Table 1 below.

TABLE 1

| sample | Flask(s) | Δ lib. | barcode | HIV_pol | MS2 |
| --- | --- | --- | --- | --- | --- |
| 293T | ABC | – | 34.8 ± 2.2 | 13.9 ± 0.6 | 30.8 ± 0.2 |
| 293T | KLM | + | 16.9 ± 0.2 | 13.1 ± 0.3 | 29.1 ± 0.8 |
| passage 3 | C | – | 34.8 ± 0.1 | 11.0 ± 0.1 | 29.6 ± 0.3 |
| passage 3 | K | + | 16.8 ± 0.2 | 11.9 ± 0.1 | 30.7 ± 0.3 |
| passage 3 | L | + | 15.8 ± 0.8 | 11.5 ± 0.1 | 30.7 ± 0.2 |
| passage 3 | M | + | 16.5 ± 0.2 | 11.2 ± 0.1 | 30.6 ± 0.1 |
| passage 6 | C | – | 34.7 ± 0.3 | 11.7 ± 0.1 | 30.3 ± 0.2 |
| passage 6 | K | + | 16.7 ± 0.4 | 10.9 ± 0.1 | 29.7 ± 0.4 |
| passage 6 | L | + | 17.7 ± 0.2 | 11.8 ± 0.1 | 30.1 ± 0.4 |
| passage 6 | M | + | 17.5 ± 0.3 | 12.1 ± 0.1 | 30.3 ± 0.1 |
| passage 9 | C | – | 35.2 ± 0.8 | 12.0 ± 0.1 | 29.1 ± 0.4 |
| passage 9 | K | + | 17.7 ± 0.1 | 11.4 ± 0.1 | 29.5 ± 0.2 |
| passage 9 | L | + | 18.1 ± 0.2 | 11.9 ± 0.1 | 29.5 ± 0.2 |
| passage 9 | M | + | 17.7 ± 0.1 | 11.5 ± 0.1 | 29.8 ± 0.1 |
| passage 12 | C | – | 35.3 ± 0.3 | 13.6 ± 0.1 | 32.7 ± 0.2 |
| passage 12 | K | + | 18.6 ± 0.2 | 11.4 ± 0.3 | 30.6 ± 0.1 |
| passage 12 | L | + | 17.3 ± 0.2 | 10.1 ± 0.1 | 29.7 ± 0.4 |
| passage 12 | M | + | 17.6 ± 0.1 | 10.6 ± 0.1 | 30.0 ± 0.4 |
| Media only | | – | >40 | 37 ± 1 | 30.6 ± 0.9 |
| 80 ng MS2 RNA | | – | 39.6 ± 0.2 | 35.2 ± 0.6 | 11.6 ± 0.1 |
| NTC (no template Ctrl) | | | >40 | 37 ± 2.1 | 36.9 ± 0.3 |
| 293T pool, –RT | | + | 24.7 ± 0.2 | 21.3 ± 0.2 | 34 ± 1 |
| P3 pool, –RT | CKLM | + | 29.2 ± 0.2 | 24.9 ± 0.1 | 34 ± 1.6 |
| P6 pool, –RT | CKLM | + | 30.1 ± 0.3 | 24.8 ± 0.3 | 35.8 ± 0.9 |
| P9 pool, –RT | CKLM | + | 31.2 ± 0.1 | 25.1 ± 0.4 | 35.6 ± 0.3 |
| P12 pool, –RT | CKLM | + | 31.2 ± 0.5 | 24.3 ± 0.1 | 35.9 ± 0.4 |

HIV pol was detected in the cultures containing WT virus, but was only detectable at background levels in media obtained from uninfected MT-4 cells. BC was detectable in supernatant from cultures containing the deletion library (KLM), but only at background levels in the WT only culture (C). In samples where reverse transcriptase was not added, (–RT), levels of barcode cassette and pol were >10 $C_q$ above the +RT controls, indicating that DNA contamination was negligible (RNA predominates by ≈1000× over cDNA). Without intending to be bound by any particular theory, the source of DNA is likely cell fragments and membrane blebs from dying cells. Contamination may also be due to reverse transcription products from intravirion reverse transcription, a phenomenon observed in retroviruses. As levels of DNA were low compared to RNA, additional DNAseI treatment was not performed before downstream processing.

Throughout the passage, levels of BC and POL remained relatively constant from passage to passage and between the three triplicate flasks (K/L/M). Thus the barcoded deletion mutants were stably maintained. No differences in total HIV copy number from flasks with and without the NL4-3Δ$_1$ library were observed, indicating no significant amounts of aggregated interference from mutants lacking pol.

Intracellular RNA was also isolated from 293T cells that were transfected with pNL4-3 (WT HIV) and the pNL4-3Δ$_1$ deletion library and RT-qPCR was performed. Total RNA was isolated with TRI-Reagent, and a poly(A) fraction was obtained by annealing to paramagnetic poly-dT beads. The total RNA fraction contained a considerable amount of DNA (from transfection plasmids), but the poly(A) fractionation effectively removed most of this. The poly(A) fraction corresponds to poly(A) mRNA, which requires complete transcription. RT-qPCR results are listed in Table 2. As with the supernatant data in Table 1, BC was only detected when the deletion library was included, and BC and POL were not detectable in naïve 293T cells.

TABLE 2

HIV-1 qPCR data (transfection, intracellular)

| sample | Flask(s) | WT | Δ | barcode | HIV_pol | MS2 |
| --- | --- | --- | --- | --- | --- | --- |
| total | naïve | – | – | 34.6 ± 0.7 | 29.9 ± 0.1 | 36.9 ± 0.2 |
| total | ABC | + | – | 34.6 ± 0.4 | 13.6 ± 0.1 | 37.6 ± 0.7 |
| total | KLM | + | + | 17.2 ± 0.3 | 14.0 ± 0.1 | 37.2 ± 0.2 |
| poly(A) | naïve | – | – | 33.6 ± 0.7 | 28.9 ± 0.4 | 35.7 ± 0.4 |
| poly(A) | ABC | + | – | 34.3 ± 0.5 | 14.9 ± 0.1 | 35.8 ± 0.2 |
| poly(A) | KLM | + | + | 18.1 ± 0.1 | 15.6 ± 0.2 | 37.2 ± 0.7 |
| total | pooled, –RT | + | + | 23.6 ± 0.5 | 19.8 ± 0.2 | 36.7 ± 0.6 |
| poly(A) | pooled, –RT | + | + | 30.4 ± 0.3 | 32.3 ± 0.9 | 36.0 ± 0.1 |
| MS2 | N/A | – | – | 36.1 ± 1.4 | 36.5 ± 0.5 | 28.4 ± 0.2 |
| NTC | N/A | – | – | >40 | 34 ± 5 | 37.0 ± 0.8 |

Example 7

Preparation and Analysis of Barcode Data

This Example details a method of preparing sequencing libraries of barcode sequences and identifying cis- and trans-acting regions of viruses.

In order to function as an effective TIP, a viral mutant must retain all necessary cis-acting elements required for replication so that it may be complemented by the wildtype virus. In this example, the cis and trans-acting elements of HIV-1 are identified by genetic screen by serial, high-MOI passage of NL4-3 and the NL4-3Δ$_1$ deletion library prepared as described above.

In a high MOI infection, trans factors are provided by co-infection with replication-competent virus. Therefore, genome regions that can tolerate deletion (as measured by enrichment of specific barcodes) correspond to trans-acting elements while regions that are intolerant of deletion correspond to cis-acting elements. By passaging random deletion libraries of a virus under high MOI conditions, a practitioner can functionally characterize the collection of diverse deletion mutants in order to map cis-acting elements of HIV-1. Viral mutants which persist through multiple passages are either (a) replication-competent or (b) able to be trans-complemented by the wildtype virus.

Two technical considerations should be considered when planning the experiment. To achieve efficient trans-complementation, cells should be infected at a high MOI, so that on average, each cell is infected with more than one virus, and preferably at least one copy of the wildtype virus to supply trans factors. For MOI>5, the majority of cells should receive at least one copy of the wildtype genome to supply the missing trans factors.

For the second consideration, undersampling of the library can prevent acquisition of meaningful data from the experiment. Thus, to keep strong selective pressure and to avoid drift, the diversity of the library should be limited to be fewer than the number of infected cells, so that most of the library will be sampled multiple times during infection.

In this example, the passaging was performed with 3 biological replicates (flasks K, L, M) that were seeded from a common pool of virus. Thus, mutants which are reliably enriched in all three flasks can be identified as retaining all cis-acting elements with high confidence. A parallel control was also developed, where only the wildtype virus would be introduced (flasks A, B, C). In this wildtype only arm (flasks A,B,C), no tagged deletion mutants (barcode cassette) are expected to be observed. The experiment is diagrammed in FIG. 24.

Materials and Methods
Preparation of Barcode Sequencing Libraries

Figure 23:
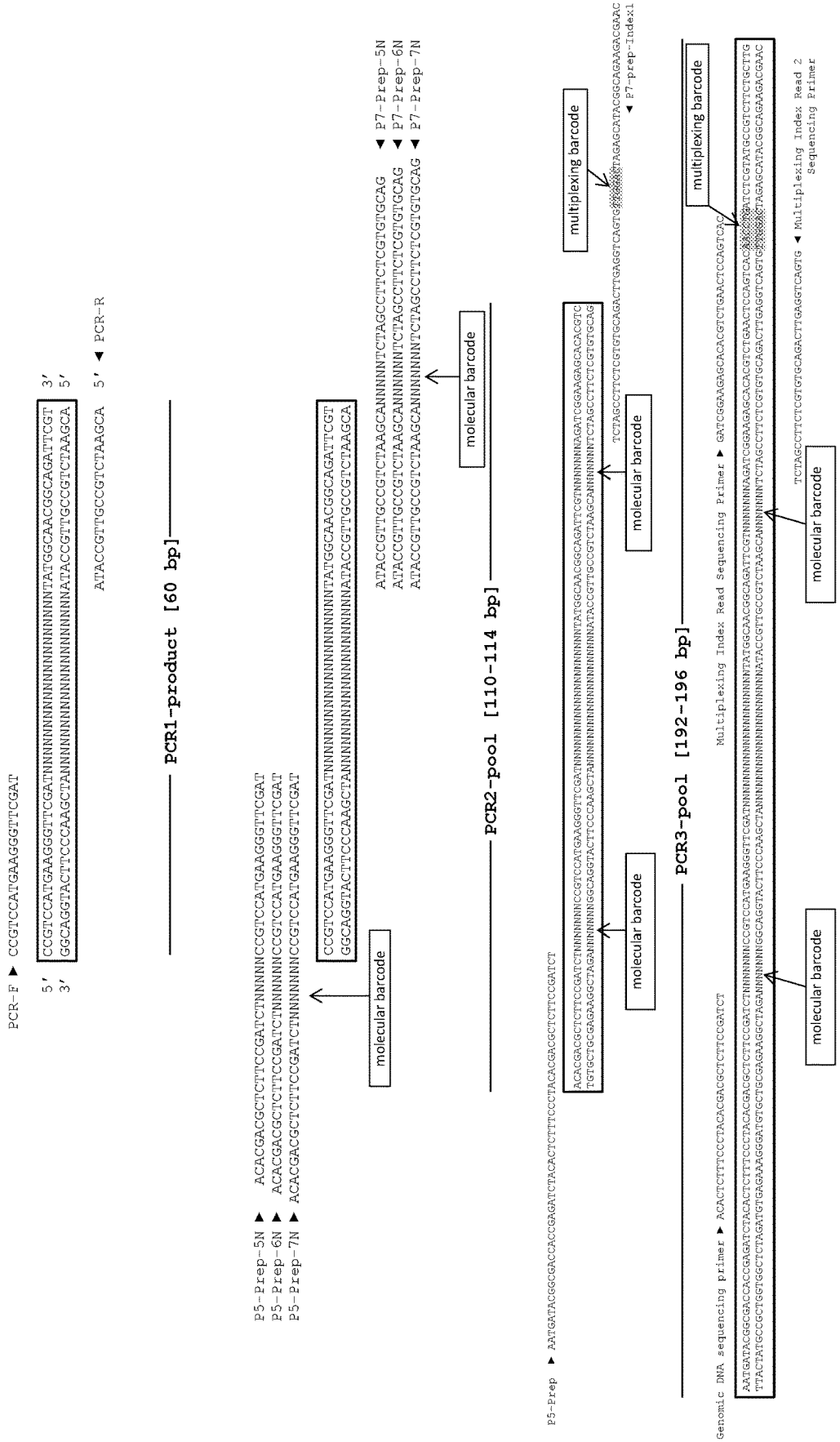
FIG. 23 provides a schematic illustrating the preparation of Illumina sequencing libraries from PCR of barcode cassettes, version 1. Three consecutive PCT reactions were used to add adapter sequences compatible with the TruSeq sequencing system. Introduction of molecular barcodes and multiplexing barcodes, allowed for high-throughput quantification of the barcoded libraries (SEQ ID NOs: 9, 11, 14 and 165-181).

Illumina sequencing libraries were prepared by a method as detailed in FIG. 23. Barcode cassettes were amplified from cDNA from above using a minimum number of cycles (typically 12-18) to prevent overamplification (post log-phase PCR) as evidenced by the RT-qPCR data from above. Illumina adaptors were added by two rounds of PCR (5 cycles each), to add phasing adaptors, random barcodes, and multiplexing barcodes. Sublibraries were size-selected on 5% TBE polyacrylamide gels and pooled for sequencing.

20-30 sublibraries were sequenced on two lanes of a HiSeq4000 (Illumina) (spiked with 25% PhiX), using a single 1×50 b reads.

Barcodes were tallied using custom Python software and matched to deletion loci using the lookup table prepared previously to calculate deletion depth.

Robustness of Barcode Passage

Using the $C_q$ values of barcode cassettes measured by RT-qPCR in Example 6 (cf. Tables 1 and 2), Illumina sequencing libraries were prepared to characterize which barcodes were persisted throughout the high MOI passage. Barcode cassettes were amplified exponentially for a minimum number of cycles, and then multiplexing indices and Illumina TruSeq adapters were added by two additional rounds of PCR. From RT-qPCR, it was established that the number of template molecules for each PCR reaction was >$10^7$. Using the barcode-to-deletion mapping for the 23,851 mappable mutants in pNL4-3$\Delta_1$, the count of each barcode cassette (with a known deletion locus), was tabulated, and used to compute the prevalence, $f_i$ of each barcode cassette i in each sample.

Identification of Cis-Acting Elements through High MOI Passage

The pool of NL4-3$\Delta_1$ deletion mutants was passaged 12 times at high multiplicity-of-infection (MOI) in a permissive T-cell line, MT-4. Samples were collected every 3 passages and deletion depth profiles built by deep sequencing of the barcoded deletion mutants.

Results
Robustness of Barcode Passage

Figure 28:
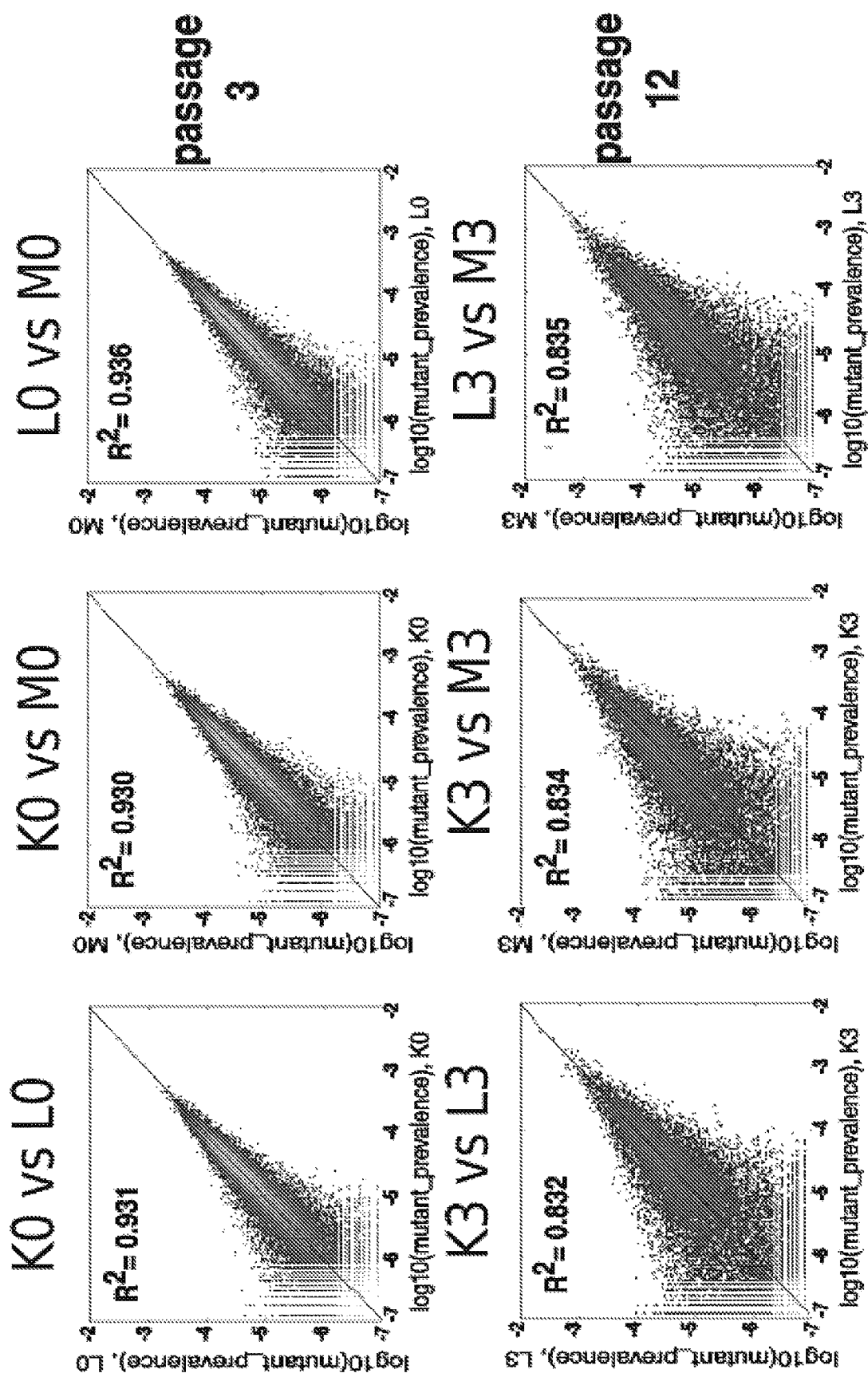
FIG. 28 provides pairwise drop plots showing $R^2$ values of 0.83-0.93 at passage 3 and passage 12, respectively, for an exemplary HIV-1 high-MOI passage screen.

Pairwise correlation plots of all barcodes in triplicate flasks (K,L,M) at passage 3 and passage 12 are plotted in FIG. 28. Coefficients of determination ($R^2$) at early time-points (passage 3) were on average greater than at passage 12 ($R^2 \cong 0.93$) and at later timepoints dipped slightly to ($R^2 \cong 0.83$). Thus, there was strong concordance between the triplicate infections at each stage of passage scheme. Thus, the selection scheme is robust. Knowledge that a particular barcode is enriched in one replicate provides confidence that the same barcode will be reliably enriched in the other replicate flasks. For most barcodes, knowledge of barcode prevalence in one flask is predictive of the prevalence in other flasks.

Identification of Deleterious and Adaptive Mutations

During high MOI passage, two phenotypes of deletion mutants that persist throughout passage are selected. Persistent mutants are either replication-competent (are self-mobilized) or are replication-defective but can be efficiently trans-complemented by the wildtype virus.

Using deep sequencing, the prevalence of each mutant in the total population of barcoded mutants was tabulated, and c prevalence trajectories computed throughout the passage. If a particular mutation becomes more prevalent over time, it is adaptive: it confers a fitness advantage (fitness is greater than average fitness at that point). If a particular mutant or mutation becomes less prevalent, then the mutation is deleterious (fitness decrease relative to average fitness). If prevalence remains constant, then the mutation is neutral. Once a mutant falls below a prevalence of 1/N where N is the population size ($10^5$ to $10^6$ in this experiment), it is likely to be lost due to drift. This corresponds to $\log_{10}$ (prevalence) of −5.0 to −6.0.

Of the 23,851 mappable NL4-3 deletion mutants, only 4390 (18%) were extant in all three replicate flasks by passage 12—the remaining 19,461 (82%) were extinct in at least one of the three replicates.

Figure 29:
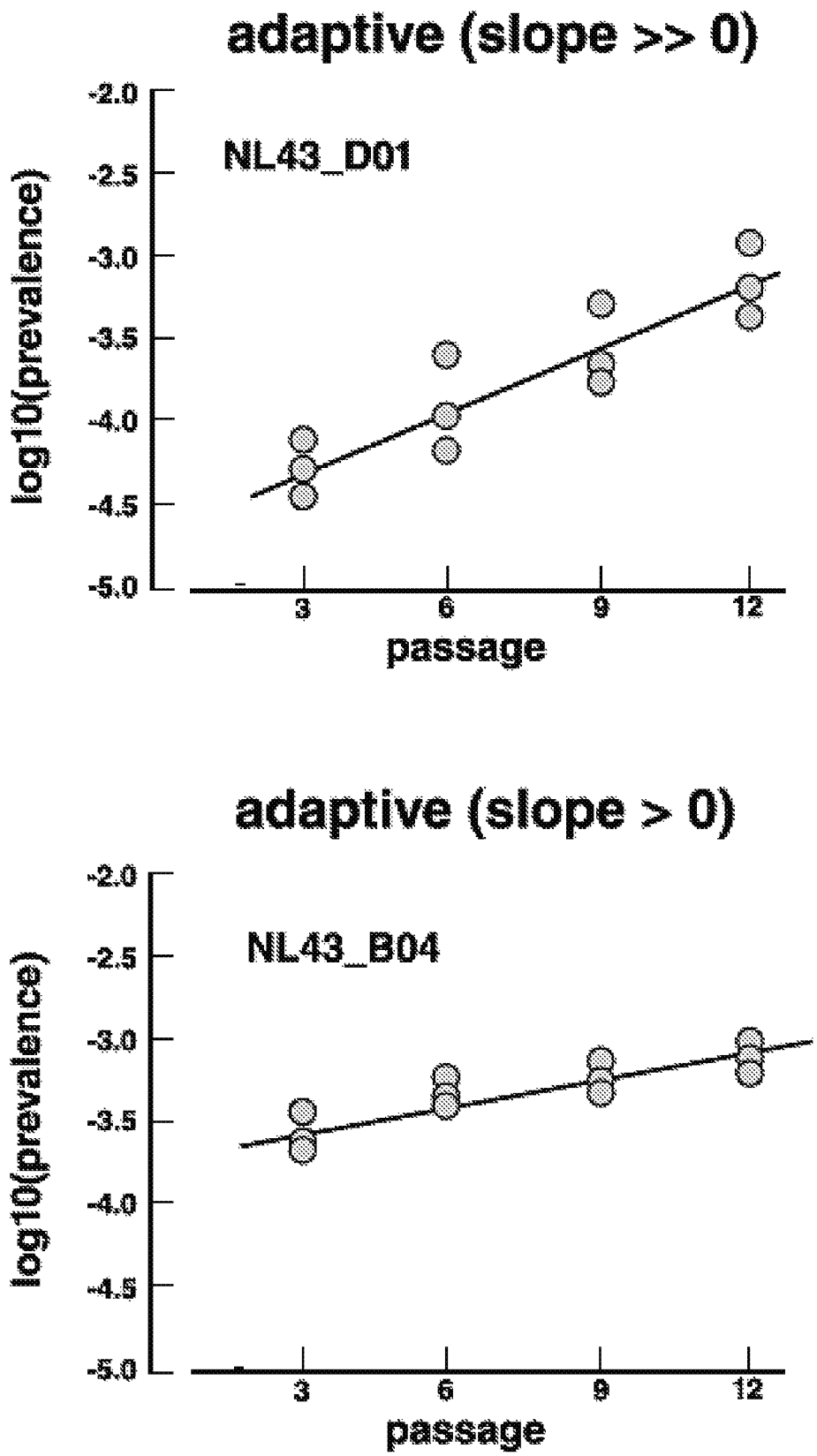
FIG. 29 provides graphs showing representative mutation trajectories during high-MOI passage. Some deletions were adaptive (NL43_D01 and NL43_B04), while others were neutral (mutant 909) or deleterious (mutant 924). Data points correspond to the triplicate flasks (K,L,M) at each passage. Prevalence is in reference to the total barcode cassette pool (tagged mutants).
Figure 30:
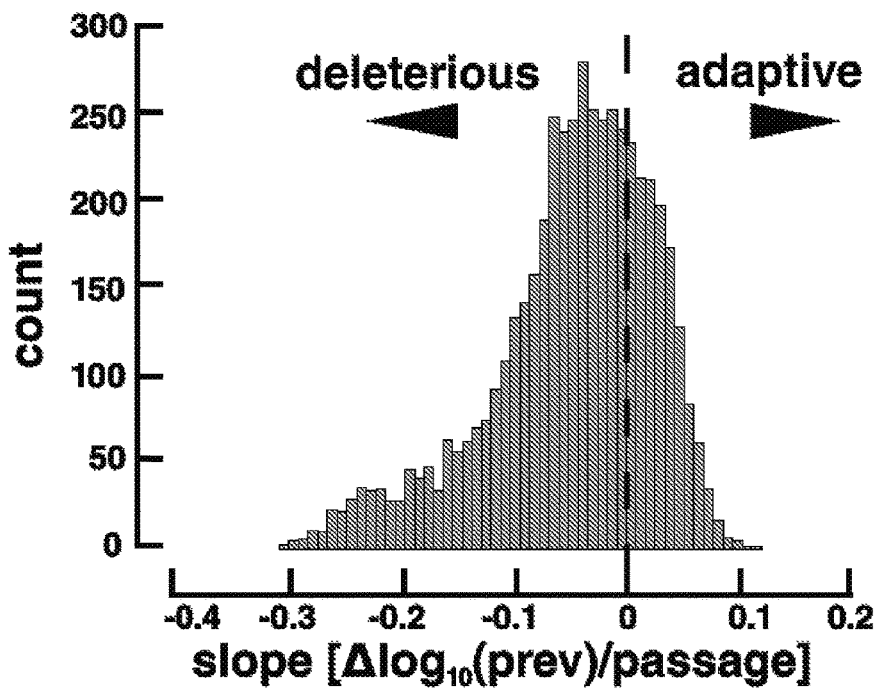
FIG. 30 provides a histogram showing the distribution of fitness in deletion mutants that are not extinct by passage 12 for an exemplary HIV-1 high-MOI passage screen. Of the 4390 mutants that are not extinct, 1390 (30%) are increasing in prevalence through every passage. The dashed vertical line marks the neutral fitness boundary (slope of 0).

Prevalence trajectories were computed for these 4390 extant mutations and the slope in prevalence was calculated versus passage number by linear regression, as shown in FIG. 29. After fitting linear regression lines to these 4390 mutants, it was observed that 1390 (32%) increased in prevalence through every passage, indicating that deletion mutants harboring these deletions were transmitting better than the average member of the barcoded population (FIG. 30). The remaining 3000 mutants remained steady or decreased in prevalence through every passage. As barcode levels were relative constant in comparison to total HIV POL (as shown previously in RT-qPCR data), it is clear that these 1390 deletions mutants were transmissible and could spread through the population as fast or faster than the wildtype virus. Thus, these 1390 deletions represent a potential collection of deletion mutants that are transmissible ($R_0$>1) under these conditions of high MOI passage in MT-4 as they are expanding in the population.

Identification of Cis-Acting and Trans-Acting Elements

Using deep sequencing counts of each barcode cassette (vector c) and the barcode-to-genotype mapping prepared in Example 3 (genotype matrix M), a deletion depth profile for the HIV-1 genome at each timepoint using the formula (d=Mc, described in Example 3) was computed. Regions where the deletion depth is large correspond to genomic intervals that are tolerant to deletion (trans-acting elements encoding common goods). Intervals where the deletion depth is low or tends to 0 correspond to cis-acting elements, and cannot be complemented in trans. Deletion depth is presented in terms of raw units (unnormalized), and depends on the sequencing depth of each library.

Figure 31:
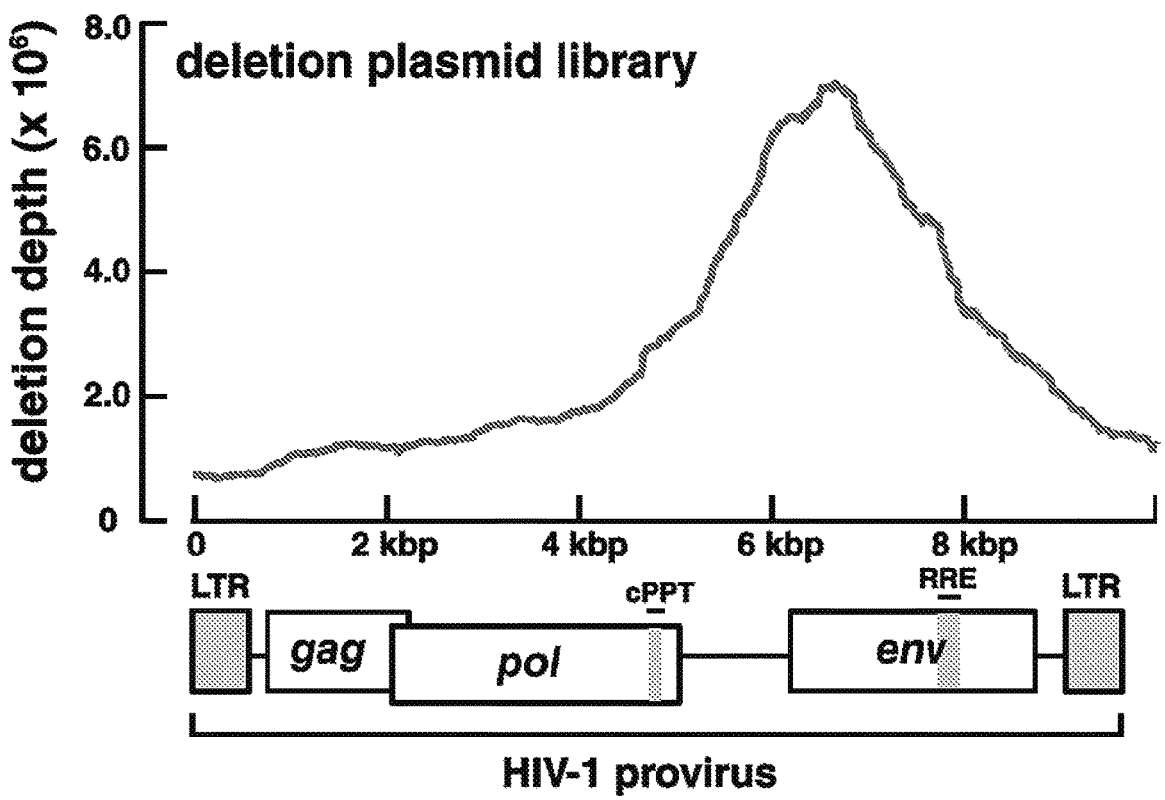
FIG. 31 provides a graph and schematic illustrating deletion depth profile of the pNL4-3$\Delta_1$ μplasmid deletion library for an exemplary HIV-1 high-MOI passage screen. The graph shows a peak centered on the signal peptide of env and coverage of the entire HIV-1 genome.

As a baseline, the deletion depth profile of the pNL4-3$\Delta_1$ deletion library across the pNL4-3 provirus was computed, shown in FIG. 31. The deletion depth across the genome is nonzero and flat across 0-4 kbp before rising to a peak centered at the N-terminus of env, and falling towards the 3' end of the genome. Bias in deletion depth at this stage corresponds to differences in growth rate in the *E. coli* host harboring each plasmid. Faster growing bacteria will cause their harbored plasmid to be overrepresented in the library. The signal peptide of env and sequences at the N-terminus are known to be toxic to bacteria, therefore bacteria harboring env deletion mutant plasmids are likely to outgrow bacteria harboring plasmids that retain env.

Cis-Acting Elements Required for Transcription

Figure 32:
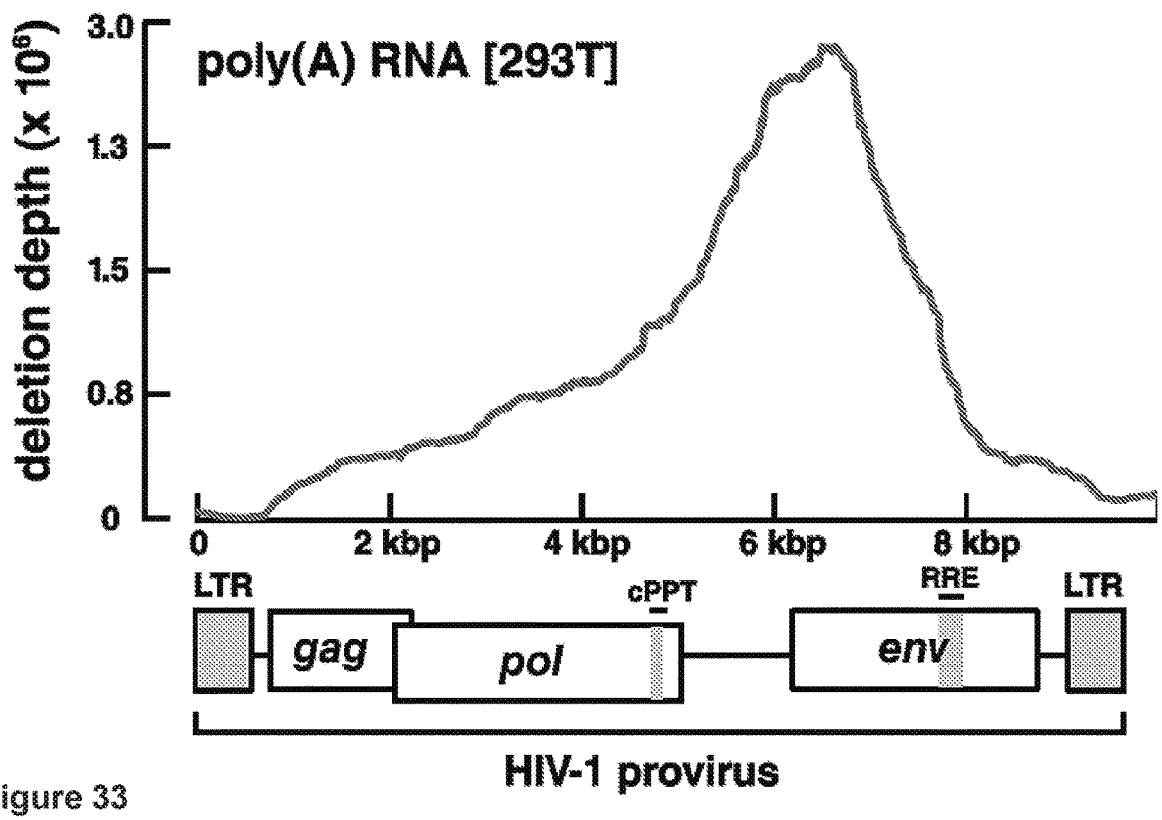
FIG. 32 provides a graph and schematic illustrating that the 5' LTR and UTR are required for efficient transcription as shown for an exemplary HIV-1 high-MOI passage screen. The deletion depth profile of poly(A) RNA from transfected 293T is shown. The graph shows a region of near-zero deletion depth at the 5' end of the genome.

The poly(A) fraction of RNA isolated from 293T co-transfected with the pNL4-3Δ$_1$ deletion library and pNL4-3 represents mRNA. Barcodes found in this fraction represent genomes that have been successfully transcribed from the HIV-1 provirus. Areas of low deletion depth (compared to the plasmid library profile) correspond to cis-acting elements required for transcription in 293T. A deletion depth profile for this poly(A) RNA fraction is shown in FIG. 32.

The deletion depth profile of the poly(A) fraction has the same basic profile as the plasmid deletion library with two notable differences. Deletions at the 5' end of the genome (spanning the 5' LTR through SL1-SL4) strongly inhibit transcription, as reflected by the low deletion depth. These regions encode the LTR promoter and regions necessary for splicing and efficient transcription (TAR loop). At the 3' end of the genome, there is a decrease in deletion depth after the RRE, falling towards the 3' LTR with respect to the plasmid deletion library profile in FIG. 31.

Cis-Acting Elements Required for Encapsidation and Egress

Figure 33:
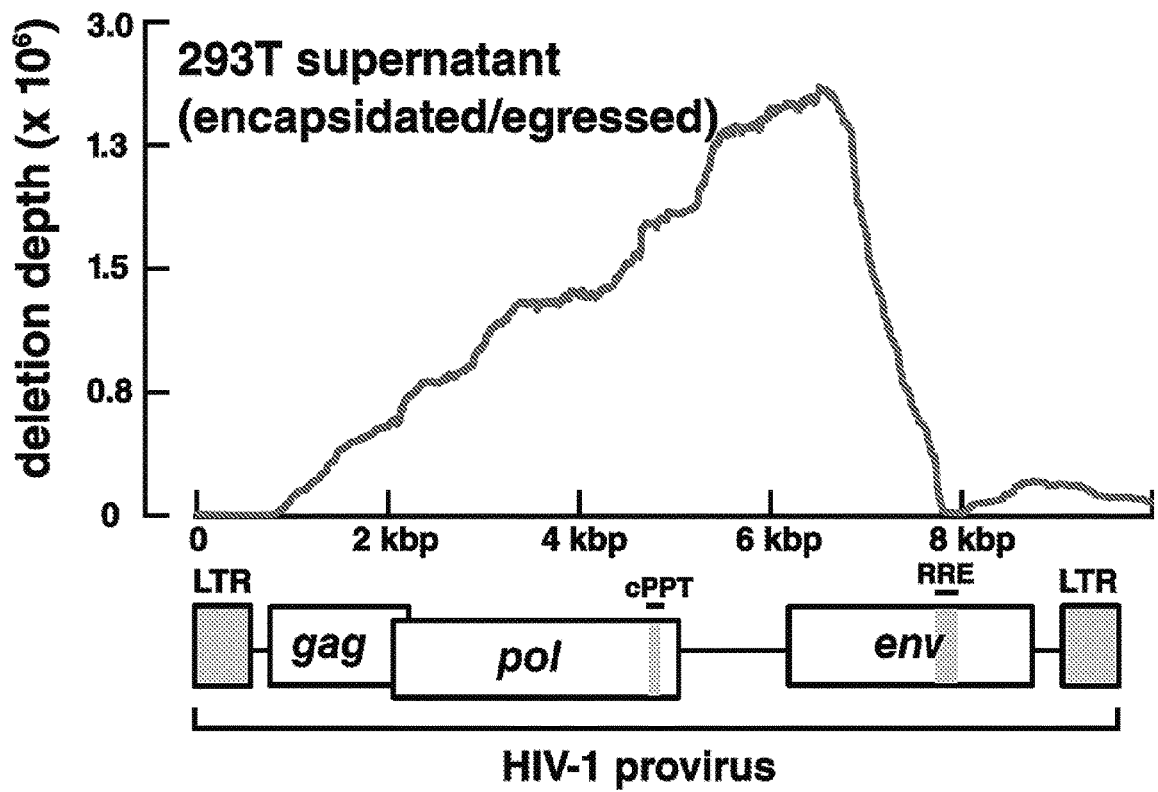
FIG. 33 provides a graph and schematic illustrating that the 5' LTR and HIV-1 RRE are required for export and encapsidation as shown for an exemplary HIV-1 high-MOI passage screen. A deletion depth profile built from tagged viral deletion mutants in the supernatant of transfected 293T. Important regions are the 5' end of the genome (5'LTR, 5'UTR, and the RRE).

A deletion depth profile of RNAs that were present in the virus-containing fraction of supernatant from transfected 293T was computed next. Barcodes found in this fraction have tagged viral genomes that could be transcribed, exported from the nucleus, and packaged into virions (encapsidated), and exported from the cell (egressed). As shown in FIG. 33, the deletion depth profile is strikingly different from the transcription of plasmid library profiles, and shows two key areas of low deletion depth, which correspond to cis-acting elements that are required for transcription and encapsidation. At the 5' end of the genome, there is an area of zero deletion depth that begins at the 5' LTR and continues through the 5' UTR, (SL1,SL2,SL3,SL4) to the start codon of gag. This region is often referred to as LP, the lentiviral packaging element, and is present in many lentiviral vectors. Structural studies have identified this region to be a minimal packaging element.

At the 3' end of the genome, there is a region of zero deletion depth that maps exactly to the Rev Responsive Element (RRE), a region of secondary structure that binds HIV-1 Rev to export incompletely spliced RNAs from the nucleus via the Crm1 pathway. The RRE is important for the steps of nuclear export and encapsidation, but this experiment cannot differentiate between nuclear export or encapsidation as the potential block, as nuclear/cytoplasmic fractionation of RNAs was not performed.

These two regions (5' LTR/UTR and RRE) appear to be the only elements required for transcription and encapsidation of the viral genome—all other genome intervals can tolerate some amount of deletion. This is in contrast to literature reports of the GRPE (a region at the frameshift of gag/pol, that is putatively necessary for genome encapsidation (Chamanian, M. et al. *Cell Host & Microbe*, 13, 181-92 (2013)). It is however, consistent with a model of Gag binding to ψ and the RRE of HIV-1 (Kutluay, S. B. & Bieniasz, P. D. *PLoS Pathogens*, 6, e1001200 (2010); Kutluay, S. B. et al. Cell 159, 1096-1109 (2014)).

Identification of Cis-Acting Elements through High MOI Passage

Figure 34:
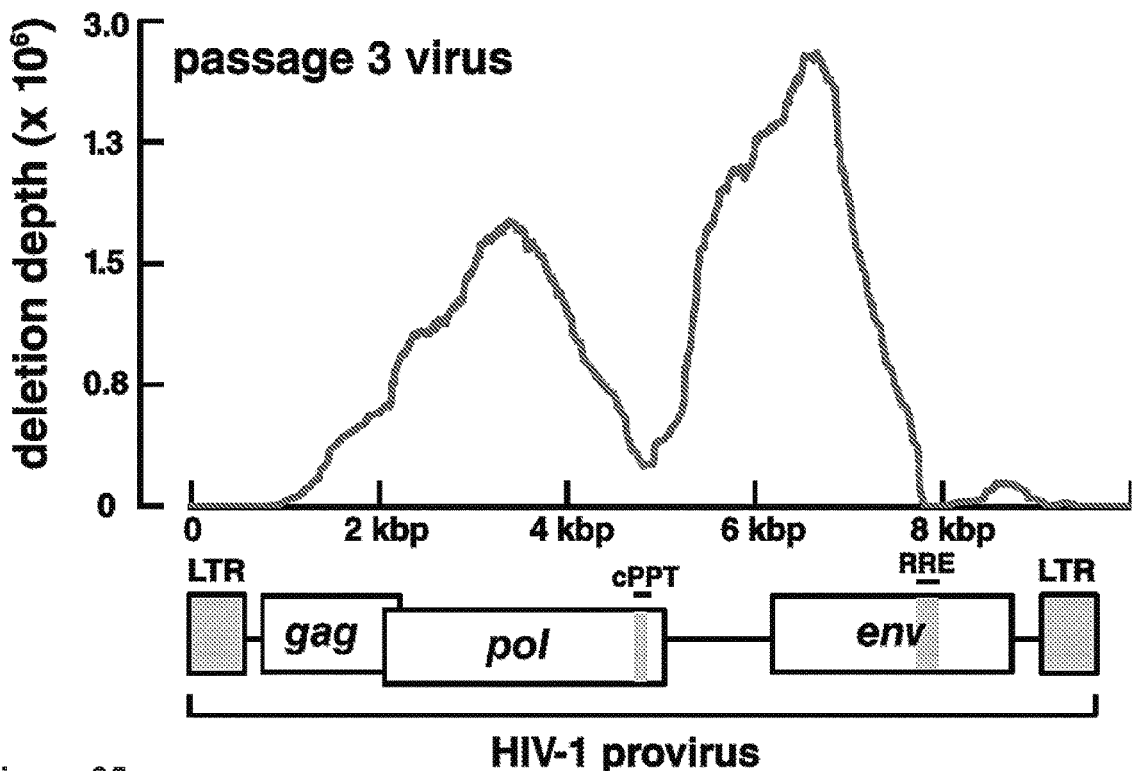
FIG. 34 provides a graph and schematic showing deletion depth profile after 3 high MOI passages in MT-4 for an exemplary HIV-1 high-MOI passage screen. Important cis-acting regions are the 5' end of the genome (5' LTR through Gag Matrix (p17)), cPPT/CTS, RRE, and the 3' end of the genome (PPT-3' LTR).
Figure 35:
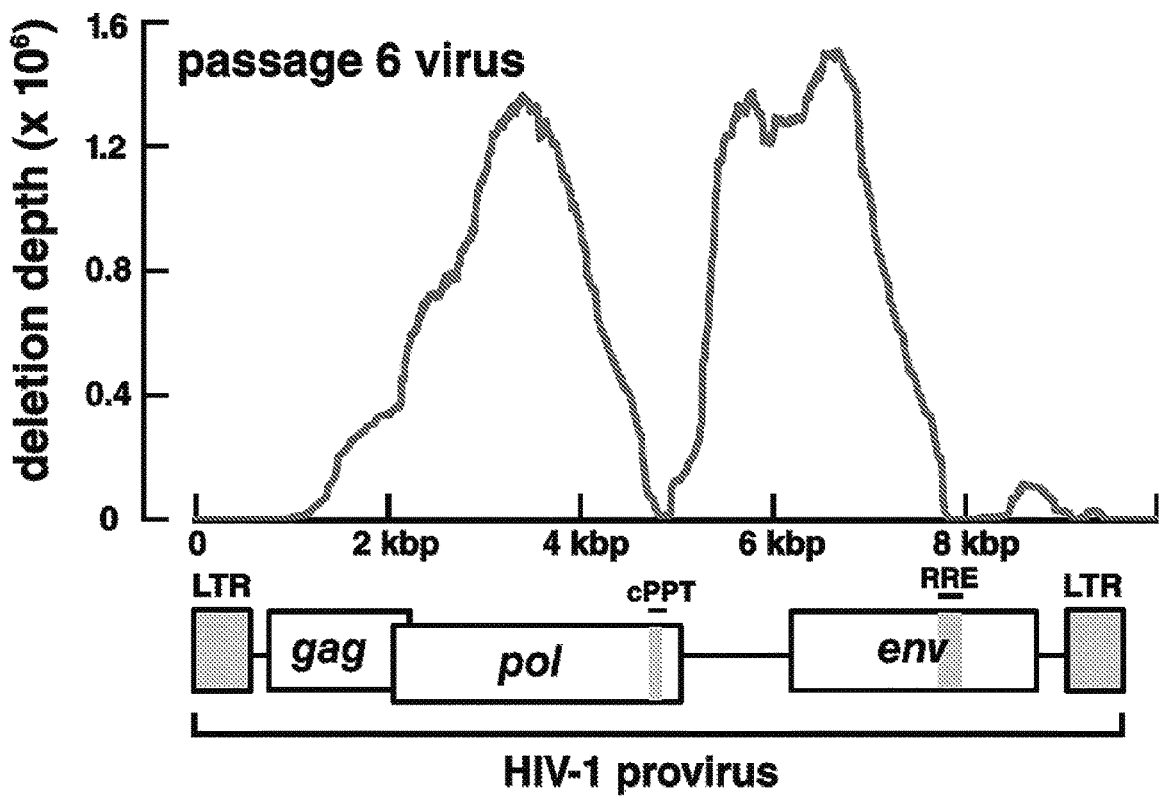
FIG. 35 provides a graph and schematic showing deletion depth profile after 6 high MOI passages in MT-4 for an exemplary HIV-1 high-MOI passage screen. Important cis-acting regions are the 5' end of the genome (5' LTR through Gag Matrix (p17)), cPPT/CTS, RRE, and the 3' end of the genome (PPT-3' LTR).
Figure 36:
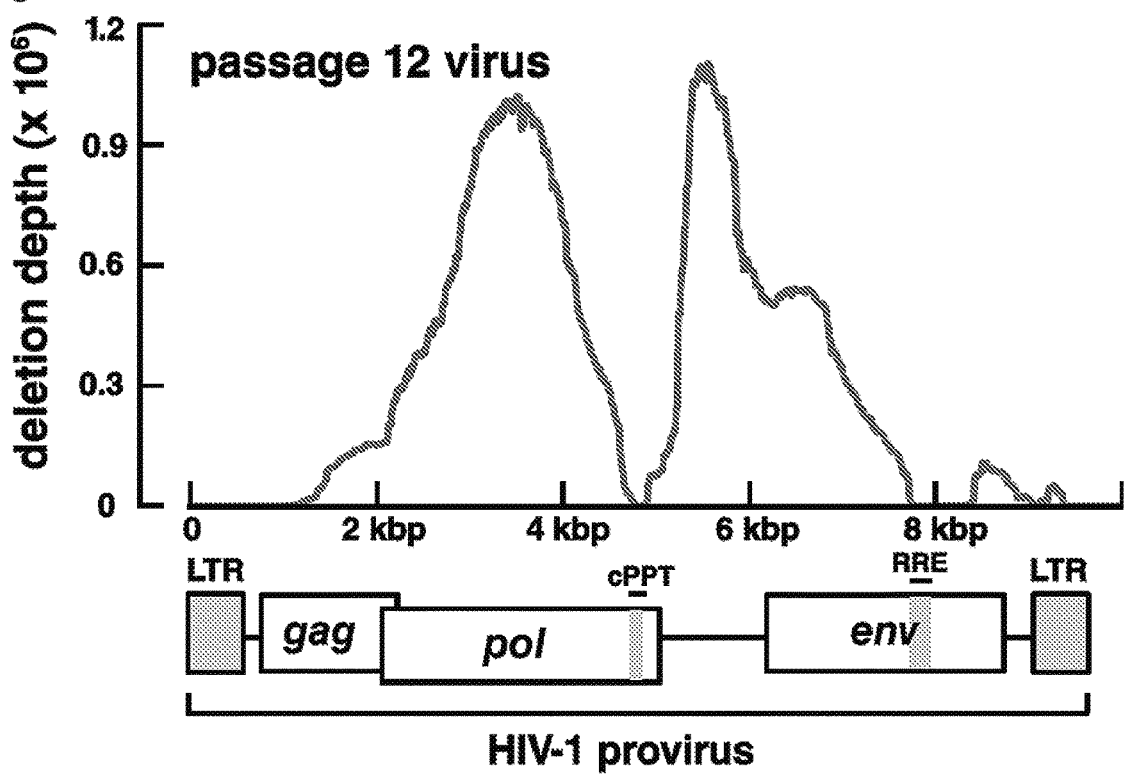
FIG. 36 provides a graph and schematic showing deletion depth profile after 12 high MOI passages in MT-4 for an exemplary HIV-1 high-MOI passage screen. Important cis-acting regions are the 5' end of the genome (5' LTR through Gag Matrix (p17)), cPPT/CTS, RRE, and the 3' end of the genome (PPT-3' LTR).

Deletion depth profiles at passage 3, passage 6, and passage 12 are shown in FIG. 34, FIG. 35, and FIG. 36. At passage 3, the deletion depth profile plotted in FIG. 34 diverges notably from the 293T supernatant profile (FIG. 33). There are three key differences: (1) a valley that appears with a minimum centered above the cPPT/CTS (2) a shift of the region of zero-deletion depth at the 5' end of the genome, which now encompasses the 5' LTR, 3' UTR, and the first three hundred bases of gag, (3) a widening and 3' shift of the valley situated above the RRE.

After 6 in vitro passages (FIG. 35), these features become more pronounced where each valley flattens to a deletion depth of zero. The 5' shoulder of the peak situated above env also appears to increase in height.

After 12 high MOI in vitro passages (FIG. 36), areas of low deletion depth (indicating intolerance to deletion) have flattened and reached a deletion depth of approximately zero. This actual deletion depth is non-zero (values of 10-300), and without intending to be bound by any particular theory, could reflect cross-talk between libraries during demultiplexing on the Illumina platform in addition to persistent mutants.

Figure 37:
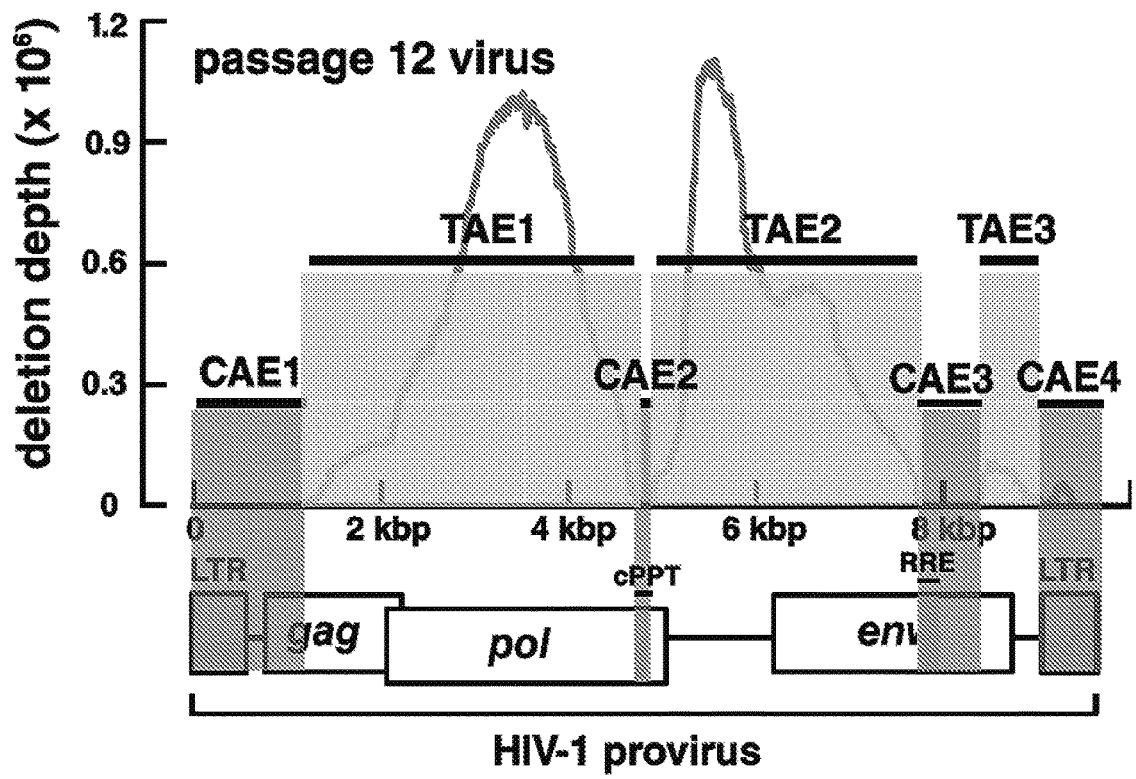
FIG. 37 provides a graph and schematic model of HIV-1 cis- and trans-acting genomic elements based on an exemplary HIV-1 high-MOI passage screen. The HIV-1 genome is composed of 4 cis-acting elements, CAE1-CAE4, and 3 trans-acting elements, TAE1-TAE3.

Using these data, a model for the cis- and trans-acting elements of HIV-1 was constructed in FIG. 37. Three regions of the HIV-1 genome are tolerant to deletion, indicating that they encode elements that can be complemented efficiently in trans. The deletion depth profile at passage 12 is annotated in FIG. 37.

This model shows trans-acting element "mountains" and one trans-acting "hill", with peaks at the center of pol (trans-acting element 1: TAE1), in the accessory gene tract of HIV (vif-vpu) (TAE2), and in the 3' end of env. The deletion depth profile in TAE1 (gag-pol) has a small shoulder and an inflection point corresponding to the start codon of pol. The deletion depth profile of TAE2 (post cPPT to pre-RRE) has a shoulder corresponding to the start codon of env. The last trans-acting element (TAE3) begins after splice acceptor 7 (SA7) which marks the second exon of tat and rev, and ends at the PPT. The last hill after TAE3 (within the U3 region of the 3' LTR) may be an artifact due to the mechanism of HIV-1 genome replication, where the U3 region of the 3' LTR is copied to the 5' end of the DNA genome during reverse transcription. Thus, mutants with apparent deletions in U3 may persist The deletion depth profile after passage 12 also contains four regions of low or zero deletion depth, indicating that these genomic regions cannot tolerate deletion and cannot be complemented efficiently in trans: these regions are putative cis-acting elements (CAE).

CAE1 is 1115 bp in length and maps to nucleotides 1-1114 of NL4-3 proviral genome. This 5' end of genome encompasses the 5' LTR, stem loops 1-4, and the first 325 b of gag, which maps to the Gag MA (p17). This region is included in lentiviral vectors and a minimal packaging element, ψ, has been mapped to this region. Why deletions in Gag MA are not tolerated remains unknown, although others have speculated that there is a relationship between encapsidation and translation of the HIV-1 genome.

CAE2 is 126 bp in length and maps to nucleotides 4779-4905 of NL4-3, at the 3' end of env. This region maps exactly to the cPPT/CTS, a region previously identified as being necessary for reverse-transcription and integration of HIV-1. This region is conserved in lentiviruses but not retroviruses.

CAE3 is 671 bp in length and maps to nucleotides 7710-8381 of NL4-3, at the 3' end of env. It begins exactly at the RRE, and ends precisely at splice acceptor 7 (SA7). This splice acceptor is used for splicing of several multiply spliced HIV-1 transcripts, including (vpr, tat, rev, net). This region, too, is included in many lentiviral vectors.

CAE4 is 684 bp in length and maps to nucleotides 9025-9709 of NL4-3. This region spans the PPT, necessary for reverse transcription in HIV-1 and the 3' LTR.

Cis-Acting Elements of HIV-1

Example 6 and Example 7, when taken together, provide an approach to conducting a genetic screen to map the cis- and trans-acting elements of HIV-1 as well as many other viruses. In the screen, 293T cells were transfected with the NL4-3Δ$_1$ barcoded deletion library and wildtype NL4-3 to produce a pool of infectious virus. The virus pool was then passaged 12 times at high MOI (5-20) in a T-cell line (MT-4).

During high MOI infection, target cells are infected with more than one virus with high probability, allowing replication-defective viruses that retain all necessary cis-acting elements to persist through the passage by trans-complementation with common goods produced by functional wildtype virus. Thus, this screen selects two viral phenotypes: (a) replication-competent viruses (b) replication-defective viruses that retain all necessary cis-acting elements and can be mobilized effectively by wildtype HIV-1.

Sequencing of the barcodes at critical points in the infection cycle (transcription, encapsidation/egress, passage 3, passage 6, passage 12) and referencing the barcode/deletion lookup table allowed for the identification of genomic regions where deletions were tolerated in each step of the HIV-1 replication cycle (trans-acting elements) or were intolerant to deletion (cis-acting elements).

Using the high-resolution deletion depth profiles, four distinct cis-acting elements were identified, regions that that could not be complemented in trans. These regions are annotated in FIG. 37: CAE1: nt 1-1144 of NL4-3, spanning the 5' LTR, stem loops 1-4, and the first 325 b of gag; CAE2: nt 4779-4905 of NL4-3, the cPPT/CTS; CAE3: nt 7710-8381 of NL4-3, which begins exactly at the RRE and ends precisely at splice acceptor 7 (SA7); CAE4: nt 9025-9709 of NL4-3, which covers the PPT and the 3' LTR.

Based upon these results, a minimal HIV-1 therapeutic interfering particle (in proviral form) might be obtained by concatenation of the sequences of CAE1 (1115 bp), CAE2 (126 bp), CAE3 (671 bp), and CAE4 (684 bp), which sum to a total length of 2596 bp. This assumes that the regions can act independently and the multiple deletions do not demonstrate epistasis.

Despite previous claims that the GRPE is important for encapsidation (Chamanian, M. et al. *Cell Host & Microbe*, 13, 181-92 (2013)) we show that deletions of this region do not affect mobilization, in agreement with Nikolaitchik and Hu (Nikolaitchik, O. A. & Hu, W.-S. *J. Virology* 88, 4040-4046 (2014)).

The screen was conducted using a single molecular clone of HIV-1 and a single clonal cell line. It is possible that cis-acting elements can vary between viral strains and between cell lines and tissue types.

Recombination between viruses was unmonitored, although it is known to be an important aspect for HIV-1 replication. Recombination can produce viral strains that have acquired more than one deletion, and create linkage effects. Additional sequencing outside of the barcode cassette region was not performed and the appearance of additional mutations was not examined. However, the dot plots in FIG. 28, show strong correlation between replicates, showing that the observed selection was deterministic, not in the region of drift.

Example 8

Low-MOI Screen of an HIV-1 Random Deletion Library (Prophetic)

Figure 38:
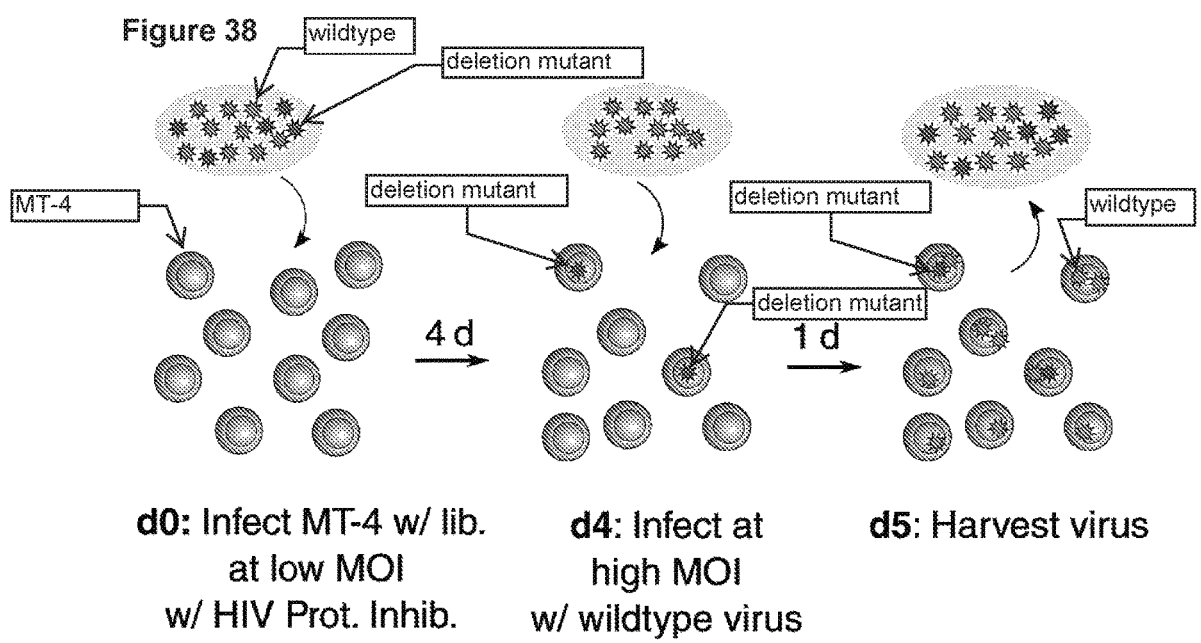
FIG. 38 provides a schematic of a Low MOI screen for noncytopathic HIV-1 DIPs according to an exemplary embodiment of the present disclosure. On day 0, MT-4 (blue double discs) are infected at low MOI with a pool of virus (HIV-1) containing both wildtype (red stars) and deletion mutants (blue stars). This infection occurs in the presence of an HIV-1 protease inhibitor, such as Darunavir, which restricts viral replication to a single round. Cells infected with cytopathic HIV-1 (such as the wildtype helper virus) are killed between 0 and 4 days post-infection. Uninfected cells and cells infected with deletion mutants that do not cause cell death are enriched. At 4 days post-infection, the entire population of cells is infected at high MOI with wildtype helper virus (red stars), to achieve efficient trans-complementation of deletion mutants. On day 5, the virus-containing supernatant is harvested, now enriched for deletion mutants that are non-cytopathic and retain all cis-acting elements. The virus pool can be used to infect cells at low MOI and the process iterated.

In a more stringent screen, the HIV-1 deletion library, pNL4-3Δ$_1$, could be passaged in permissive cells at low MOI (MOI of <1), instead of high MOI as performed in this chapter. An example scheme is depicted in FIG. 38.

Target cells are transduced/infected at low MOI with a pool of virus containing tagged deletion mutants and wildtype helper virus, and then allowed to recover in the presence of a drug (or neutralizing antibody) to restrict viral replication to a single round. During the recovery period, cells infected with wildtype virus or cytopathic deletion mutants will be killed, while uninfected cells and cells infected with non-cytopathic deletion mutants will survive. After the recovery period, the population of cells is infected at high MOI with the wildtype virus to mobilize deletion mutants. In this fashion, deletion mutants which do not kill their host cell but also retain all cis-acting elements required for transmission can be selected.

The low MOI screen is more stringent than a high MOI screen performed above, as it selects for mutants that are non-cytopathic but can be mobilized. The high MOI screen selects for mutants that are replication-competent or can be mobilized by the wildtype virus, but does not select for or against cell killing. Successive passages (every 24 hours), are performed before cell death occurs in HIV-1 infections, typically 24-72 hours post-infection (Perelson, A. S. & Nelson, P. W. *SIAM Review*, 41, 3-44 (1999).

Example 9

Construction and Evaluation of Prototype DIPs for HIV-1

This Example describes how viral strains harboring multiple adaptive deletions can be recovered from data obtained during a high-MOI or low-MOI screen of a random deletion library.

An ideal transmissible antiviral (a DIP/TIP) would possess the following qualities: (1) it would compete effectively for common goods provided by the wildtype helper virus during co-infection (interference) (2) it would be retain all necessary cis-acting elements required for efficient mobilization by the helper virus (mobilization, $R_0$>1), (3) it would be unable to transmit without co-infection with wildtype helper virus (no self-replication).

The results of the high MOI passage screen for HIV-1 cis-acting elements in Examples 6 and 7 can be used to develop transmissible antivirals against HIV-1. From the deletion depth profile, we were able to identify four cis-acting elements that were intolerant of deletion and could not be complemented in trans. Therefore, any HIV-1 potential transmissible antiviral must retain these regions in its genome. Concatenation of these four cis-acting elements provides the minimum proviral size of an HIV-1 transmissible antiviral, about 2.6 kbp.

The high MOI passage of the pNL4-3Δ$_1$ deletion library also allowed an estimation of the fitness effect of each deletion (see FIG. 29 and FIG. 30). While most of the 23,851 deletions were deleterious (about 95%), 1390 mutants consistently increased in prevalence within the barcoded pool, suggesting these mutations had an adaptive effect (increase in $R_0$). A subset of the adaptive mutations increased in prevalence by as much as 1-2 logo over 12 passages.

By generating viral mutants harboring one or multiple adaptive deletions, as identified in the high MOI screen, it may be possible to assemble a library of potential TIPs. Such viruses can be further optimized by point mutations and further deletion.

In this Example, a collection of 60 HIV-1 subgenomic deletion mutants are reconstituted from adaptive deletions identified from the high MOI screen in Example 6 and Example 7. A subset of these satisfy the basic requirements of a transmissible antiviral in single-round replication studies: they interfere with HIV-1 replication, reducing wildtype viral loads; they can be mobilized by the wildtype helper virus to new cells, and they do not self-replicate.

Materials and Methods

Cloning Strategy

The high MOI screen in Example 6 and Example 7 identified three trans-acting elements of the HIV-1 genome that were tolerant to deletion (FIG. 37). The three trans-acting elements are interleaved by four cis-acting elements that are intolerant to deletion. This genome organization can be exploited during cloning of multiply-deleted strains. As the cis-acting elements must be preserved, they can be used as fixed sequence "fasteners" to join variably-sized pieces of the trans-acting elements.

To develop a modular cloning strategy, the 9709 bp proviral genome was subdivided into 7 blocks (A, B, C, D, E, F, G) that can be joined by Gibson Assembly to create a single provirus (FIG. 39). Each block is comprised of a 400-2100 bp subsequence of pNL4-3 plasmid with flanking adapter sequences to allow assembly of full-length virus genomes by Gibson Assembly via flanking 40 bp sequences, as depicted in FIG. 39. By creating different version of blocks A through G, one can create a combinatorial library by building mutants composed of different versions of each common block to generate multiply deleted and mutated strains of HIV-1.

Using the high MOI data results, a number of deletions that were reliably enriched (4-250×) over 12 in vitro passages in all three replicates of the HIV-1 high MOI passage experiment were selected for cloning (FIG. 40 and FIG. 41). Additionally, each of the four cis-acting elements is encoded by a single block (see FIG. 39 and FIG. 41). In all, 7 mutants were selected from block B, 1 mutant from block C, 4 from block D, and 1 from block F. When combined with the wildtype piece from each block, a total of 160 viruses (159 mutants and 1 wildtype virus) can be created.

Table 3 below lists the 20 single block sequences that can be joined to generate the multiply-deleted strains of HIV-1. The sequences are provided in the attached sequence listing as SEQ ID NOs: 24-43. For each sequence, Table 3 provides a description of what deletion was made (if any) in the sequence. All numbering is with respect to the 9709 bp NL4-3 HIV-1 proviral sequence.

TABLE 3

| name | description | Δ (bp) | left | right | barcode | partially or fully deleted genes | SEQ ID NO. |
|---|---|---|---|---|---|---|---|
| NL43_A00 | HIV-1 subsequence A, WT | 0 | NA | NA | NA | None | 24 |
| NL43_B00 | HIV-1 subsequence B, WT | NA | NA | NA | NA | None | 25 |
| NL43_B01 | HIV-1 subsequence B, Δ | 1016 | 1636 | 2651 | TTGAACCCATGGCCGG ATCA (SEQ ID NO: 44) | gag/pol | 26 |
| NL43_B02 | HIV-1 subsequence B, Δ | 1361 | 1455 | 2815 | TGGACCCGCCCGGACG CTCA (SEQ ID NO: 45) | gag/pol | 27 |
| NL43_B03 | HIV-1 subsequence B, Δ | 1547 | 1448 | 2994 | CAGGCAGCTCAAGAAA CACG (SEQ ID NO: 46) | gag/pol | 28 |
| NL43_B04 | HIV-1 subsequence B, Δ | 908 | 1469 | 2376 | TCGACAGTGTAATGTCT GCA (SEQ ID NO: 47) | gag/pol | 29 |
| NL43_B05 | HIV-1 subsequence B, Δ | 825 | 1484 | 2308 | GGGGGGCGGCGATTAC TTGT (SEQ ID NO: 48) | gag/pol | 30 |
| NL43_B06 | HIV-1 subsequence B, Δ | 860 | 1469 | 2328 | GAGCTGCAGGGCATGT TATA (SEQ ID NO: 49) | gag/pol | 31 |
| NL43_B07 | HIV-1 subsequence B, Δ | 796 | 1560 | 2355 | GGCGACCCTCGGCCGT GGAC (SEQ ID NO: 50) | gag/pol | 32 |
| NL43_C00 | HIV-1 subsequence C, WT | 0 | NA | NA | NA | None | 33 |

TABLE 3-continued

| name | description | Δ (bp) | left | right | barcode | partially or fully deleted genes | SEQ ID NO. |
|---|---|---|---|---|---|---|---|
| NL43_C01 | HIV-1 subsequence C, Δ | 987 | 3620 | 4606 | CAGCTTGTTCAGATGCT GTA (SEQ ID NO: 51) | Pol | 34 |
| NL43_D00 | HIV-1 subsequence D, WT | 0 | NA | NA | NA | None | 35 |
| NL43_D01 | HIV-1 subsequence D, Δ | 986 | 5073 | 6058 | TCTTGAACAGCGCGGTC TGT (SEQ ID NO: 52) | vif/vpr/tat/ rev | 36 |
| NL43_D02 | HIV-1 subsequence D, Δ | 986 | 5073 | 6058 | D01 but without barcode | vif/vpr/tat/ rev | 37 |
| NL43_D03 | HIV-1 subsequence D, Δ | 1089 | 5071 | 6159 | GATCGGTCGTCGCAGC GGTC (SEQ ID NO: 53) | vif/vpr/tat/ rev/vpu | 38 |
| NL43_D04 | HIV-1 subsequence D, Δ | 1211 | 5041 | 6251 | TATCTGTAGCCAACATT CGA (SEQ ID NO: 54) | vif/vpr/tat/ rev/vpu/env | 39 |
| NL43_E00 | HIV-1 subsequence E, WT | 0 | NA | NA | NA | None | 40 |
| NL43_F00 | HIV-1 subsequence F, WT | 0 | NA | NA | NA | NA | 41 |
| NL43_F01 | HIV-1 subsequence F, Δ | 174 | 9116 | 9289 | CGTAAAGTGGGATAGTT TTT (SEQ ID NO: 55) | nef/U3 | 42 |
| NL43_G00 | HIV-1 subsequence G, Δ | 0 | NA | NA | NA | None | 43 |

The following system is used to describe the genotype of each virus. For each block, "00" is the wildtype version, thus the wildtype version of NL4-3 can be written descriptively (yet verbosely) as NL43_A00B00C00D00E00F00G00. A mutant which is composed of mutant blocks B02, D01 and wildtype versions of the remaining blocks has the genotype of NL43_A00B02C00D01E00F01.

Figure 39:
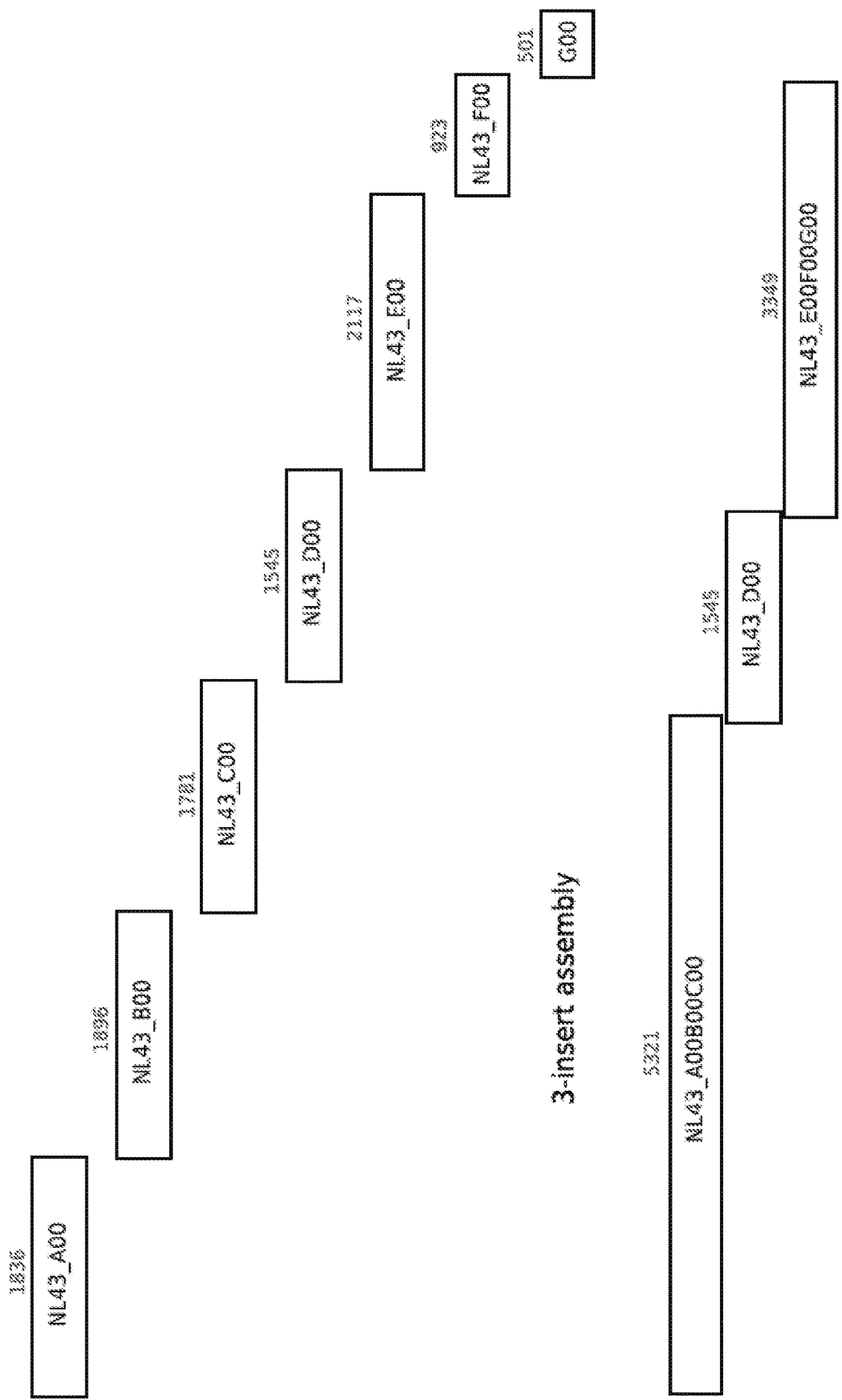
Figure 41:
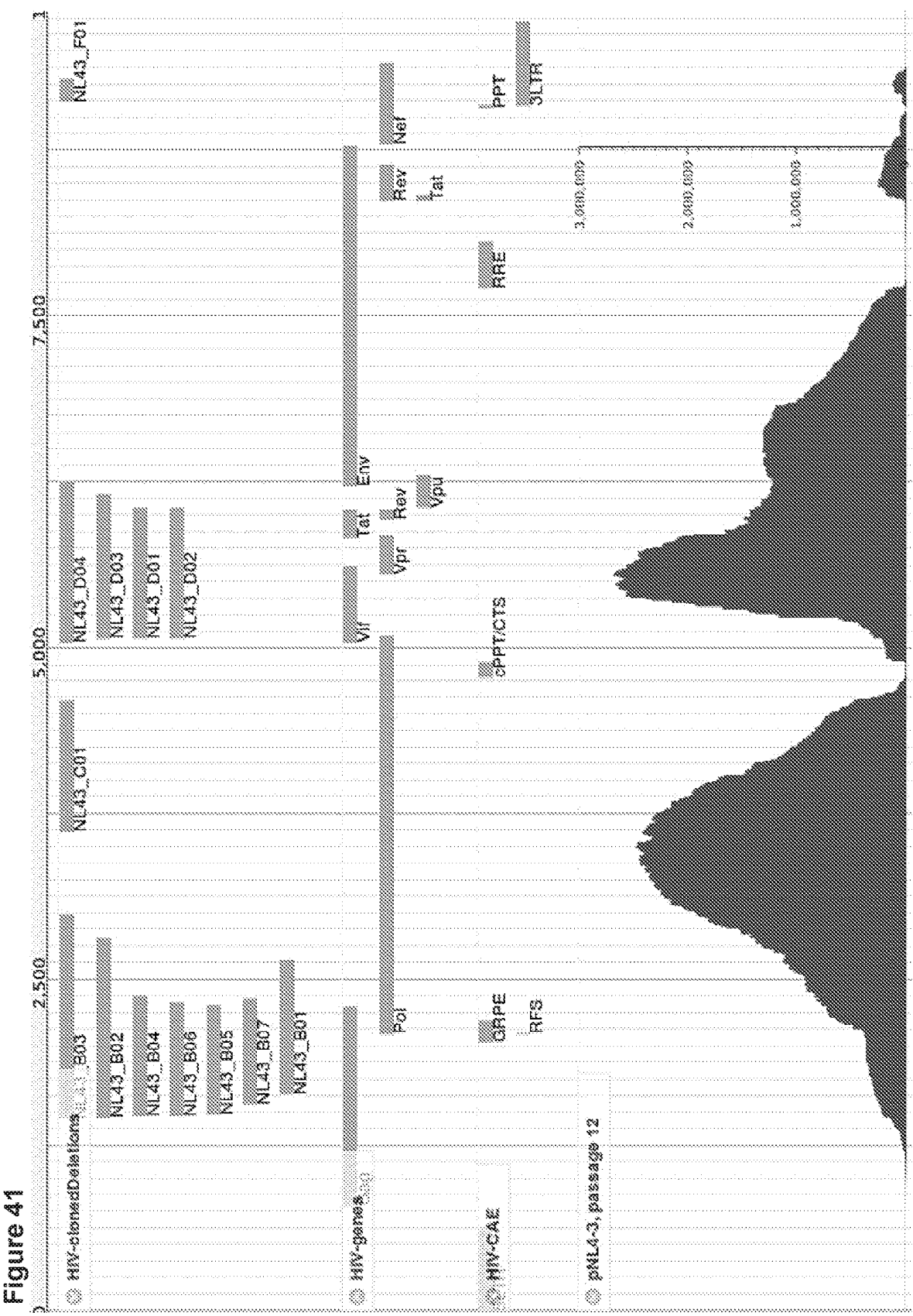

Using this combinatorial strategy, 61 viruses (60 deletion mutants and 1 wildtype virus) were prepared using the assembly strategy demonstrated in FIG. 39. A complete listing of the deletion mutants can be found in Tables 4 and 5 below. The hiv00 sequence corresponds to the 9709 bp NL4-3 provirus referred to herein. All numbering is done relative to this sequence. The publicly-available sequence is deposited in GenBank under accession number AF324493.2. The 9709 bp NL4-3 provirus corresponds to nt 1-9709 of this sequence.

TABLE 4

| seq | name | total bases deleted | deletion inteval(s) | genes/regions partially or fully deleted | notes | SEQ ID NO. |
|---|---|---|---|---|---|---|
| hiv00 | NL43_A00B00C00D00E00F00G00 | 0 | none | none | WT | 56 |
| hiv01 | NL43_A00B00C00D00E00F01G00 | 174 | 9116-9289 | nef/U3 | Δnef | 57 |
| hiv02 | NL43_A00B00C00D01E00F00G00 | 986 | 5073-6058 | vif/vpr/tat/rev | | 58 |
| hiv03 | NL43_A00B00C00D01E00F01G00 | 1160 | 5073-6058, 9116-9289 | vif/vpr/tat/rev/nef/U3 | | 59 |
| hiv04 | NL43_A00B00C00D02E00F00G00 | 986 | 5073-6058 | vif/vpr/tat/rev | | |
| hiv05 | NL43_A00B00C00D02E00F01G00 | 1160 | 5073-6058, 9116-9289 | vif/vpr/tat/rev/nef/U3 | | 61 |

TABLE 4-continued

| seq | name | total bases deleted | deletion inteval(s) | genes/regions partially or fully deleted | notes | SEQ ID NO. |
|---|---|---|---|---|---|---|
| hiv06 | NL43_A00B00C00D03E00F00G00 | 1089 | 5071-6159 | vif/vpr/tat/rev/vpu | | 62 |
| hiv07 | NL43_A00B00C00D03E00F01G00 | 1263 | 5071-6159, 9116-9289 | vif/vpr/tat/rev/vpu/nef/U3 | | 63 |
| hiv08 | NL43_A00B00C00D04E00F00G00 | 1211 | 5041-6251 | vif/vpr/tat/rev/vpu/env | | 64 |
| hiv09 | NL43_A00B00C00D04E00F01G00 | 1385 | 5041-6251, 9116-9289 | vif/vpr/tat/rev/vpu/env/nef/U3 | | 65 |
| hiv10 | NL43_A00B00C01D00E00F00G00 | 987 | 3620-4606 | pol | | 66 |
| hiv11 | NL43_A00B00C01D00E00F01G00 | 1161 | 3620-4606, 9116-9289 | pol/nef/U3 | | 67 |
| hiv12 | NL43_A00B00C01D01E00F00G00 | 1973 | 3620-4606, 5073-6058 | pol/vif/vpr/tat/rev | | 68 |
| hiv13 | NL43_A00B00C01D01E00F01G00 | 2147 | 3620-4606, 5073-6058, 9116-9289 | pol/vif/vpr/tat/rev/nef/U3 | | 69 |
| hiv14 | NL43_A00B00C01D02E00F00G00 | 1973 | 3620-4606, 5073-6058 | pol/vif/vpr/tat/rev | | 70 |
| hiv15 | NL43_A00B00C01D02E00F01G00 | 2147 | 3620-4606, 5073-6058, 9116-9289 | pol/vif/vpr/tat/rev/nef/U3 | | 71 |
| hiv16 | NL43_A00B00C01D03E00F00G00 | 2076 | 3620-4606, 5071-6159 | pol/vif/vpr/tat/rev/vpu | | 72 |
| hiv17 | NL43_A00B00C01D03E00F01G00 | 2250 | 3620-4606, 5071-6159, 9116-9289 | pol/vif/vpr/tat/rev/vpu/nef/U3 | | 73 |
| hiv18 | NL43_A00B00C01D04E00F00G00 | 2198 | 3620-4606, 5041-6251 | pol/vif/vpr/tat/rev/vpu/env | | 74 |
| hiv19 | NL43_A00B00C01D04E00F01G00 | 2372 | 3620-4606, 5041-6251-9116-9289 | pol/vif/vpr/tat/rev/vpu/env/nef/U3 | | 75 |
| hiv20 | NL43_A00B01C00D00E00F00G00 | 1016 | 1636-2651 | gag/pol | | 76 |
| hiv21 | NL43_A001301C00D01E00F00G00 | 2002 | 1636-2651, 5073-6058 | gag/pol/vif/vpr/tat/rev | | 77 |
| hiv22 | NL43_A00B01C00D04E00F00G00 | 2227 | 1636-2651, 5041-6251 | gag/pol/vif/vpr/tat/rev/vpu/env | | 78 |
| hiv23 | NL43_A001301C01D00E00F00G00 | 2003 | 1636-2651, 3620-4606 | gag/pol | | 79 |
| hiv24 | NL43_A001301C01D01E00F00G00 | 2989 | 1636-2651, 3620-4606, | gag/pol/vif/vpr/tat/rev | | 80 |

TABLE 4-continued

| seq | name | total bases deleted | deletion inteval(s) | genes/regions partially or fully deleted | notes | SEQ ID NO. |
|---|---|---|---|---|---|---|
| hiv25 | NL43_A001301C01D04E00F00G00 | 3214 | 5073-6058, 1636-2651, 3620-4606, 5041-6251 | gag/pol/vif/vpr/tat/rev/vpu/env | | 81 |
| hiv26 | NL43_A00B02C00D00E00F00G00 | 1361 | 1455-2815 | gag/pol | | 82 |
| hiv27 | NL43_A00B02C00D01E00F00G00 | 2347 | 1455-2815, 5073-6058 | gag/pol/vif/vpr/tat/rev | | 83 |
| hiv28 | NL43_A00B02C00D04E00F00G00 | 2572 | 1455-2815, 5041-6251 | gag/pol/vif/vpr/tat/rev/vpu/env | | 84 |
| hiv29 | NL43_A00B02C01D00E00F00G00 | 2348 | 1455-2815, 3620-4606 | gag/pol | | 85 |
| hiv30 | NL43_A00B02C01D01E00F00G00 | 3334 | 1455-2815, 3620-4606, 5073-6058 | gag/pol/vif/vpr/tat/rev | | 86 |
| hiv31 | NL43_A00B02C01D04E00F00G00 | 3559 | 1455-2815, 3620-4606, 5041-6251 | gag/pol/vif/vpr/tat/rev/vpu/env | | 87 |
| hiv32 | NL43_A00B03C00D00E00F00G00 | 1547 | 1448-2994 | gag/pol | | 88 |
| hiv33 | NL43_A00B03C00D01E00F00G00 | 2533 | 1448-2994, 5073-6058 | gag/pol/vif/vpr/tat/rev | | 89 |
| hiv34 | NL43_A00B03C00D04E00F00G00 | 2758 | 1448-2994, 5041-6251 | gag/pol/vif/vpr/tat/rev/vpu/env | | 90 |
| hiv35 | NL43_A00B03C01D00E00F00G00 | 2534 | 1448-2994, 3620-4606 | gag/pol | | 91 |
| hiv36 | NL43_A00B03C01D01E00F00G00 | 3520 | 1448-2994, 3620-4606, 5073-6058 | gag/pol/vif/vpr/tat/rev | | 92 |
| hiv37 | NL43_A00B03C01D04E00F00G00 | 3745 | 1448-2994, 3620-4606, 5041-6251 | gag/pol/vif/vpr/tat/rev/vpu/env | | 93 |
| hiv38 | NL43_A00B04C00D00E00F00G00 | 908 | 1469-2376 | gag/pol | | 94 |
| hiv39 | NL43_A00B04C00D01E00F00G00 | 1894 | 1469-2376, 5073-6058 | gag/pol/vif/vpr/tat/rev | | 95 |
| hiv40 | NL43_A00B04C00D04E00F00G00 | 2119 | 1469-2376, 5041-6251 | gag/pol/vif/vpr/tat/rev/vpu/env | | 96 |
| hiv41 | NL43_A00B04C01D00E00F00G00 | 1895 | 1469-2376, 3620-4606 | gag/pol | | 97 |
| hiv42 | NL43_A00B04C01D01E00F00G00 | 2881 | 1469-2376, | gag/pol/vif/vpr/tat/rev | | 98 |

TABLE 4-continued

| seq | name | total bases deleted | deletion inteval(s) | genes/regions partially or fully deleted | notes | SEQ ID NO. |
|---|---|---|---|---|---|---|
| hiv43 | NL43_A00B04C01D04E00F00G00 | 3106 | 3620-4606, 5073-6058 1469-2376, 3620-4606, 5041-6251 | gag/pol/vif/vpr/tat/rev/vpu/env | | 99 |
| hiv44 | NL43_A00B05C00D00E00F00G00 | 825 | 1484-2308 | gag/pol | | 100 |
| hiv45 | NL43_A00B05C00D01E00F00G00 | 1811 | 1484-2308, 5073-6058 | gag/pol/vif/vpr/tat/rev | | 101 |
| hiv46 | NL43_A00B05C00D04E00F00G00 | 2036 | 1484-2308, 5041-6251 | gag/pol/vif/vpr/tat/rev/vpu/env | | 102 |
| hiv47 | NL43_A00B05C01D00E00F00G00 | 1812 | 1484-2308, 3620-4606 | gag/pol | | 103 |
| hiv48 | NL43_A00B05C01D01E00F00G00 | 2798 | 1484-2308, 3620-4606, 5073-6058 | gag/pol/vif/vpr/tat/rev | | 104 |
| hiv49 | NL43_A00B05C01D04E00F00G00 | 3023 | 1484-2308, 3620-4606, 5041-6251 | gag/pol/vif/vpr/tat/rev/vpu/env | | 105 |
| hiv50 | NL43_A00B06C00D01E00F00G00 | 1846 | 1469-2328, 5073-6058 | gag/pol/vif/vpr/tat/rev | | 106 |
| hiv51 | NL43_A00B06C00D04E00F00G00 | 2071 | 1469-2328, 5041-6251 | gag/pol/vif/vpr/tat/rev/vpu/env | | 107 |
| hiv52 | NL43_A00B06C01D00E00F00G00 | 1847 | 1469-2328, 3620-4606 | gag/pol | | 108 |
| hiv53 | NL43_A00B06C01D01E00F00G00 | 2833 | 1469-2328, 3620-4606, 5073-6058 | gag/pol/vif/vpr/tat/rev | | 109 |
| hiv54 | NL43_A00B06C01D04E00F00G00 | 3058 | 1469-2328, 3620-4606, 5041-6251 | gag/pol/vif/vpr/tat/rev/vpu/env | | 110 |
| hiv55 | NL43_A00B07C00D00E00F00G00 | 796 | 1560-2355 | gag/pol | | 111 |
| hiv56 | NL43_A00B07C00D01E00F00G00 | 1782 | 1560-2355, 5073-6058 | gag/pol/vif/vpr/tat/rev | | 112 |
| hiv57 | NL43_A00B07C00D04E00F00G00 | 2007 | 1560-2355, 5041-6251 | gag/pol/vif/vpr/tat/rev/vpu/env | | 113 |
| hiv58 | NL43_A00B07C01D00E00F00G00 | 1783 | 1560-2355, 3620-4606 | gag/pol | | 114 |
| hiv59 | NL43_A00B07C01D01E00F00G00 | 2769 | 1560-2355, | gag/pol/vif/vpr/tat/rev | | 115 |

TABLE 4-continued

| seq | name | total bases deleted | deletion inteval(s) | genes/regions partially or fully deleted | notes | SEQ ID NO. |
|---|---|---|---|---|---|---|
| hiv60 | NL43_A00B07C01D04E00F00G00 | 2994 | 3620-4606, 5073-6058 1560-2355, 3620-4606, 5041-6251 | gag/pol/vif/vpr/tat/rev/vpu/env | | 116 |

TABLE 5

| strain | plasmid_name | seq | name | total bases deleted | deletion interval(s) | genes/regions partially or fully deleted |
|---|---|---|---|---|---|---|
| BTN400 | pUC19-NL43_A00B01C00D00E00F00G00 | hiv20 | NL43_A00B01C00D00E00F00G00 | 1016 | 1636-2651 | gag/pol |
| BTN401 | pUC19-NL43_A00B01C00D01E00F00G00 | hiv21 | NL43_A00B01C00D01E00F00G00 | 2002 | 1636-2651, 5073-6058 | gag/pol/vif/vpr/tat/rev |
| BTN402 | pUC19-NL43_A00B01C00D04E00F00G00 | hiv22 | NL43_A00B01C00D04E00F00G00 | 2227 | 1636-2651, 5041-6251 | gag/pol/vif/vpr/tat/rev/vpu/env |
| BTN403 | pUC19-NL43_A00B01C01D01E00F00G00 | hiv24 | NL43_A00B01C01D01E00F00G00 | 2989 | 1636-2651, 3620-4606, 5073-6058 | gag/pol/vif/vpr/tat/rev |
| BTN404 | pUC19-NL43_A00B02C00D00E00F00G00 | hiv26 | NL43_A00B02C00D00E00F00G00 | 1361 | 1455-2815 | gag/pol |
| BTN405 | pUC19-NL43_A00B02C00D01E00F00G00 | hiv27 | NL43_A00B02C00D01E00F00G00 | 2347 | 1455-2815, 5073-6058 | gag/pol/vif/vpr/tat/rev |
| BTN406 | pUC19-NL43_A00B02C00D04E00F00G00 | hiv28 | NL43_A00B02C00D04E00F00G00 | 2572 | 1455-2815, 5041-6251 | gag/pol/vif/vpr/tat/rev/vpu/env |
| BTN407 | pUC19-NL43_A00B02C01D00E00F00G00 | hiv29 | NL43_A00B02C01D00E00F00G00 | 2348 | 1455-2815, 3620-4606 | gag/pol |
| BTN408 | pUC19-NL43_A00B02C01D01E00F00G00 | hiv30 | NL43_A00B02C01D01E00F00G00 | 3334 | 1455-2815, 3620-4606, 5073-6058 | gag/pol/vif/vpr/tat/rev |
| BTN409 | pUC19-NL43_A00B02C01D04E00F00G00 | hiv31 | NL43_A00B02C01D04E00F00G00 | 3559 | 1455-2815, 3620-4606, 5041-6251 | gag/pol/vif/vpr/tat/rev/vpu/env |
| BTN410 | pUC19-NL43_A00B03C00D01E00F00G00 | hiv33 | NL43_A00B03C00D01E00F00G00 | 2533 | 1448-2994, 5073-6058 | gag/pol/vif/vpr/tat/rev |
| BTN411 | pUC19-NL43_A00B03C00D04E00F00G00 | hiv34 | NL43_A00B03C00D04E00F00G00 | 2758 | 1448-2994, 5041-6251 | gag/pol/vif/vpr/tat/rev/vpu/env |
| BTN412 | pUC19-NL43_A00B04C00D00E00F00G00 | hiv38 | NL43_A00B04C00D00E00F00G00 | 908 | 1469-2376 | gag/pol |
| BTN413 | pUC19-NL43_A00B04C00D01E00F00G00 | hiv39 | NL43_A00B04C00D01E00F00G00 | 1894 | 1469-2376, 5073-6058 | gag/pol/vif/vpr/tat/rev |
| BTN414 | pUC19-NL43_A00B04C00D04E00F00G00 | hiv40 | NL43_A00B04C00D04E00F00G00 | 2119 | 1469-2376, 5041-6251 | gag/pol/vif/vpr/tat/rev/vpu/env |
| BTN415 | pUC19-NL43_A00B04C01D00E00F00G00 | hiv41 | NL43_A00B04C01D00E00F00G00 | 1895 | 1469-2376, 3620-4606 | gag/pol |
| BTN416 | pUC19-NL43_A00B04C01D01E00F00G00 | hiv42 | NL43_A00B04C01D01E00F00G00 | 2881 | 1469-2376, 3620-4606, 5073-6058 | gag/pol/vif/vpr/tat/rev |
| BTN417 | pUC19-NL43_A00B04C01D04E00F00G00 | hiv43 | NL43_A00B04C01D04E00F00G00 | 3106 | 1469-2376, 3620-4606, 5041-6251 | gag/pol/vif/vpr/tat/rev/vpu/env |

TABLE 5-continued

| strain | plasmid_name | seq | name | total bases deleted | deletion interval(s) | genes/regions partially or fully deleted |
|---|---|---|---|---|---|---|
| BTN418 | pUC19-NL43_A00B05C00D00E00F00G00 | hiv44 | NL43_A00B05C00D00E00F00G00 | 825 | 1484-2308 | gag/pol |
| BTN419 | pUC19-NL43_A00B05C00D01E00F00G00 | hiv45 | NL43_A00B05C00D01E00F00G00 | 1811 | 1484-2308, 5073-6058 | gag/pol/vif/vpr/tat/rev |
| BTN420 | pUC19-NL43_A00B05C00D04E00F00G00 | hiv46 | NL43_A00B05C00D04E00F00G00 | 2036 | 1484-2308, 5041-6251 | gag/pol/vif/vpr/tat/rev/vpu/env |
| BTN421 | pUC19-NL43_A00B05C01D00E00F00G00 | hiv47 | NL43_A00B05C01D00E00F00G00 | 1812 | 1484-2308, 3620-4606 | gag/pol |
| BTN422 | pUC19-NL43_A00B05C01D01E00F00G00 | hiv48 | NL43_A00B05C01D01E00F00G00 | 2798 | 1484-2308, 3620-4606, 5073-6058 | gag/pol/vif/vpr/tat/rev |
| BTN423 | pUC19-NL43_A00B05C01D04E00F00G00 | hiv49 | NL43_A00B05C01D04E00F00G00 | 3023 | 1484-2308, 3620-4606, 5041-6251 | gag/pol/vif/vpr/tat/rev/vpu/env |
| BTN424 | pUC19-NL43_A00B06C00D01E00F00G00 | hiv50 | NL43_A00B06C00D01E00F00G00 | 1846 | 1469-2328, 5073-6058 | gag/pol/vif/vpr/tat/rev |
| BTN425 | pUC19-NL43_A00B06C00D04E00F00G00 | hiv51 | NL43_A00B06C00D04E00F00G00 | 2071 | 1469-2328, 5041-6251 | gag/pol/vif/vpr/tat/rev/vpu/env |
| BTN426 | pUC19-NL43_A00B06C01D01E00F00G00 | hiv53 | NL43_A00B06C01D01E00F00G00 | 2833 | 1469-2328, 3620-4606, 5073-6058 | gag/pol/vif/vpr/tat/rev |
| BTN427 | pUC19-NL43_A00B06C01D04E00F00G00 | hiv54 | NL43_A00B06C01D04E00F00G00 | 3058 | 1469-2328, 3620-4606, 5041-6251 | gag/pol/vif/vpr/tat/rev/vpu/env |
| BTN428 | pUC19-NL43_A00B07C00D00E00F00G00 | hiv55 | NL43_A00B07C00D00E00F00G00 | 796 | 1560-2355 | gag/pol |
| BTN429 | pUC19-NL43_A00B07C00D01E00F00G00 | hiv56 | NL43_A00B07C00D01E00F00G00 | 1782 | 1560-2355, 5073-6058 | gag/pol/vif/vpr/tat/rev |
| BTN430 | pUC19-NL43_A00B07C00D04E00F00G00 | hiv57 | NL43_A00B07C00D04E00F00G00 | 2007 | 1560-2355, 5041-6251 | gag/pol/vif/vpr/tat/rev/vpu/env |
| BTN431 | pUC19-NL43_A00B07C01D00E00F00G00 | hiv58 | NL43_A00B07C01D00E00F00G00 | 1783 | 1560-2355, 3620-4606 | gag/pol |
| BTN432 | pUC19-NL43_A00B07C01D01E00F00G00 | hiv59 | NL43_A00B07C01D01E00F00G00 | 2769 | 1560-2355, 3620-4606, 5073-6058 | gag/pol/vif/vpr/tat/rev |
| BTN433 | pUC19-NL43_A00B07C01D04E00F00G00 | hiv60 | NL43_A00B07C01D04E00F00G00 | 2994 | 1560-2355, 3620-4606, 5041-6251 | gag/pol/vif/vpr/tat/rev/vpu/env |
| BTN434 | pUC19-NL43_A001301C01D00E00F00G00 | hiv23 | NL43_A00B01C01D00E00F00G00 | 2003 | 1636-2651, 3620-4606 | gag/pol |
| BTN435 | pUC19-NL43_A001301C01D00E00F00G00 | hiv23 | NL43_A00B01C01D00E00F00G00 | 2003 | 1636-2651, 3620-4606 | gag/pol |
| BTN436 | pUC19-NL43_A00B01C01D04E00F00G00 | hiv25 | NL43_A00B01C01D04E00F00G00 | 3214 | 1636-2651, 3620-4606, 5041-6251 | gag/pol/vif/vpr/tat/rev/vpu/env |
| BTN437 | pUC19-NL43_A00B01C01D04E00F00G00 | hiv25 | NL43_A00B01C01D04E00F00G00 | 3214 | 1636-2651, 3620-4606, 5041-6251 | gag/pol/vif/vpr/tat/rev/vpu/env |
| BTN438 | pUC19-NL43_A00B03C00D00E00F00G00 | hiv32 | NL43_A00B03C00D00E00F00G00 | 1547 | 1448-2994 | gag/pol |
| BTN439 | pUC19-NL43_A00B03C00D00E00F00G00 | hiv32 | NL43_A00B03C00D00E00F00G00 | 1547 | 1448-2994 | gag/pol |
| BTN440 | pUC19-NL43_A00B03C01D00E00F00G00 | hiv35 | NL43_A00B03C01D00E00F00G00 | 2534 | 1448-2994, 3620-4606 | gag/pol |
| BTN441 | pUC19-NL43_A00B03C01D00E00F00G00 | hiv35 | NL43_A00B03C01D00E00F00G00 | 2534 | 1448-2994, 3620-4606 | gag/pol |
| BTN442 | pUC19-NL43_A00B03C01D01E00F00G00 | hiv36 | NL43_A00B03C01D01E00F00G00 | 3520 | 1448-2994, 3620-4606, 5073-6058 | gag/pol/vif/vpr/tat/rev |

TABLE 5-continued

| strain | plasmid_name | seq | name | total bases deleted | deletion interval(s) | genes/regions partially or fully deleted |
|---|---|---|---|---|---|---|
| BTN443 | pUC19-NL43_A00B03C01D01E00F00G00 | hiv36 | NL43_A00B03C01D01E00F00G00 | 3520 | 1448-2994, 3620-4606, 5073-6058 | gag/pol/vif/vpr/tat/rev |
| BTN444 | pUC19-NL43_A00B03C01D04E00F00G00 | hiv37 | NL43_A00B03C01D04E00F00G00 | 3745 | 1448-2994, 3620-4606, 5041-6251 | gag/pol/vif/vpr/tat/rev/vpu/env |
| BTN445 | pUC19-NL43_A00B03C01D04E00F00G00 | hiv37 | NL43_A00B03C01D04E00F00G00 | 3745 | 1448-2994, 3620-4606, 5041-6251 | gag/pol/vif/vpr/tat/rev/vpu/env |
| BTN446 | pUC19-NL43_A00B06C01D00E00F00G00 | hiv52 | NL43_A00B06C01D00E00F00G00 | 1847 | 1469-2328, 3620-4606 | gag/pol |
| BTN447 | pUC19-NL43_A00B06C01D00E00F00G00 | hiv52 | NL43_A00B06C01D00E00F00G00 | 1847 | 1469-2328, 3620-4606 | gag/pol |
| BTN454 | pUC19-NL43_A00B01C00D00E00F00G00 | hiv20 | NL43_A00B01C00D00E00F00G00 | 1016 | 1636-2651 | gag/pol |
| BTN477 | pUC19-NL43_A00B00C00D01E00F00G00 | hiv02 | NL43_A00B00C00D01E00F00G00 | 986 | 5073-6058 | vif/vpr/tat/rev |
| BTN478 | pUC19-NL43_A00B00C00D02E00F00G00 | hiv04 | NL43_A00B00C00D0E00F00G00 | 986 | 5073-6058 | vif/vpr/tat/rev |
| BTN479 | pUC19-NL43_A00B00C00D03E00F00G00 | hiv06 | NL43_A00B00C00D03E00F00G00 | 1089 | 5071-6159 | vif/vpr/tat/rev/vpu |
| BTN480 | pUC19-NL43_A00B00C00D04E00F00G00 | hiv08 | NL43_A00B00C00D04E00F00G00 | 1211 | 5041-6251 | vif/vpr/tat/rev/vpu/env |
| BTN481 | pUC19-NL43_A00B00C00D01E00F01G00 | hiv03 | NL43_A00B00C00D01E00F01G00 | 1160 | 5073-6058, 9116-9289 | vif/vpr/tat/rev/nef/U3 |
| BTN482 | pUC19-NL43_A00B00C00D02E00F01G00 | hiv05 | NL43_A00B00C00D02E00F01G00 | 1160 | 5073-6058, 9116-9289 | vif/vpr/tat/rev/nef/U3 |
| BTN483 | pUC19-NL43_A00B00C00D03E00F01G00 | hiv07 | NL43_A00B00C00D03E00F01G00 | 1263 | 5071-6159, 9116-9289 | vif/vpr/tat/rev/vpu/nef/U3 |
| BTN484 | pUC19-NL43_A00B00C00D04E00F01G00 | hiv09 | NL43_A00B00C00D04E00F01G00 | 1385 | 5041-6251, 9116-9289 | vif/vpr/tat/rev/vpu/env/nef/U3 |
| BTN485 | pUC19-NL43_A00B00C00D04E00F01G00 | hiv09 | NL43_A00B00C00D04E00F01G00 | 1385 | 5041-6251, 9116-9289 | vif/vpr/tat/rev/vpu/env/nef/U3 |
| BTN486 | pUC19-NL43_A00B00C00D04E00F01G00 | hiv09 | NL43_A00B00C00D04E00F01G00 | 1385 | 5041-6251, 9116-9289 | vif/vpr/tat/rev/vpu/env/nef/U3 |
| BTN487 | pUC19-NL43_A00B00C01D00E00F00G00 | hiv10 | NL43_A00B00C01D00E00F00G00 | 987 | 3620-4606 | pol |
| BTN488 | pUC19-NL43_A00B00C01D00E00F00G00 | hiv10 | NL43_A00B00C01D00E00F00G00 | 987 | 3620-4606 | pol |
| BTN489 | pUC19-NL43_A00B00C01D01E00F00G00 | hiv12 | NL43_A00B00C01D01E00F00G00 | 1973 | 3620-4606, 5073-6058 | pol/vif/vpr/tat/rev |
| BTN490 | pUC19-NL43_A00B00C01D02E00F00G00 | hiv14 | NL43_A00B00C01D02E00F00G00 | 1973 | 3620-4606, 5073-6058 | pol/vif/vpr/tat/rev |
| BTN491 | pUC19-NL43_A00B00C01D02E00F00G00 | hiv14 | NL43_A00B00C01D02E00F00G00 | 1973 | 3620-4606, 5073-6058 | pol/vif/vpr/tat/rev |
| BTN492 | pUC19-NL43_A00B00C01D03E00F00G00 | hiv16 | NL43_A00B00C01D03E00F00G00 | 2076 | 3620-4606, 5071-6159 | pol/vif/vpr/tat/rev/vpu |
| BTN493 | pUC19-NL43_A00B00C01D03E00F00G00 | hiv16 | NL43_A00B00C01D03E00F00G00 | 2076 | 3620-4606, 5071-6159 | pol/vif/vpr/tat/rev/vpu |
| BTN494 | pUC19-NL43_A00B00C01D04E00F00G00 | hiv18 | NL43_A00B00C01D04E00F00G00 | 2198 | 3620-4606, 5041-6251 | pol/vif/vpr/tat/rev/vpu/env |
| BTN495 | pUC19-NL43_A00B00C01D04E00F00G00 | hiv18 | NL43_A00B00C01D04E00F00G00 | 2198 | 3620-4606, 5041-6251 | pol/vif/vpr/tat/rev/vpu/env |

TABLE 5-continued

| strain | plasmid_name | seq | name | total bases deleted | deletion interval(s) | genes/regions partially or fully deleted |
|---|---|---|---|---|---|---|
| BTN496 | pUC19-NL43_A00B00C01D00E00F01G00 | hiv11 | NL43_A00B00C01D00E00F01G00 | 1161 | 3620-4606, 9116-9289 | pol/nef/U3 |
| BTN497 | pUC19-NL43_A00B00C01D01E00F01G00 | hiv13 | NL43_A00B00C01D01E00F01G00 | 2147 | 3620-4606, 5073-6058, 9116-9289 | pol/vif/vpr/tat/rev/nef/U3 |
| BTN498 | pUC19-NL43_A00B00C01D02E00F01G00 | hiv15 | NL43_A00B00C01D02E00F01G00 | 2147 | 3620-4606, 5073-6058, 9116-9289 | pol/vif/vpr/tat/rev/nef/U3 |
| BTN499 | pUC19-NL43_A00B00C01D03E00F01G00 | hiv17 | NL43_A00B00C01D03E00F01G00 | 2250 | 3620-4606, 5071-6159, 9116-9289 | pol/vif/vpr/tat/rev/vpu/nef/U3 |
| BTN500 | pUC19-NL43_A00B00C01D03E00F01G00 | hiv17 | NL43_A00B00C01D03E00F01G00 | 2250 | 3620-4606, 5071-6159, 9116-9289 | pol/vif/vpr/tat/rev/vpu/nef/U3 |
| BTN501 | pUC19-NL43_A00B00C01D04E00F01G00 | hiv19 | NL43_A00B00C01D04E00F01G00 | 2372 | 3620-4606, 5041-6251, 9116-9289 | pol/vif/vpritat/rev/vpu/envinef/U3 |
| BTN502 | pUC19-NL43_A00B00C01D04E00F01G00 | hiv19 | NL43_A00B00C01D04E00F01G00 | 2372 | 3620-4606, 5041-6251, 9116-9289 | pol/vif/vpr/tat/rev/vpu/env/nef/U3 |
| BTN503 | pUC19-NL43_A00B00C00D00E00F00G00 | hiv00 | NL43_A00B00C00D00E00F00G00 | 0 | none | none |
| BTN504 | pUC19-NL43_A00B00C00D00E00F01G00 | hiv01 | NL43_A00B00C00D00E00F01G00 | 174 | 9116-9289 | nef/U3 |

Construction of Wildtype Single-Block Plasmids

All preparative PCR was performed using Q5 Hot Start High-Fidelity DNA Polymerase (New England Biolabs, #M0493L), hereafter referred to as Q5. All PCR was conducted at the 50 μl scale in 1×Q5 Reaction Buffer supplemented with single-thaw aliquots of dNTPs and with thermocycler parameters recommended by the Q5 manufacturer's protocol. Oligonucleotide sequences are listed in Table 6.

TABLE 6

| num | name | sequence | SEQ ID NO. |
|---|---|---|---|
| y530 | oTN5-F | /5Phos/CTGTCTCTTATACACATCTGCGGCCGC | 117 |
| y531 | oTN5-R | /5Phos/CTGTCTCTTATACACATCTTTAATTAATTCGCTACC | 118 |
| y468 | oBC20v1-F | CCGTCCATGAAGGGTTCGAT | 119 |
| y469 | oBC20v1-R | ACGAATCTGCCGTTGCCATA | 120 |
| y456 | oBC20v1-T | CCGTCCATGAAGGGTTCGATNNNNNNNNNNNNNNNNNNNNTATGGCAACGGCAGATTCGT | 121 |
| y541 | opUC19_BamHI-F | TCTAGAGTCGACCTGCAGGCATGC | 122 |
| y542 | opUC19_BamHI-R | CCGGGTACCGAGCTCGAATTCACT | 123 |
| y126 | oNL43pol-F | GAGACAGGGCAAGAAACAGC | 124 |
| y127 | oNL43pol-R | AACAGGCGGCCTTAACTGTA | 125 |
| y229 | oMS2-F | TCCTGCTCAACTTCCTGTCGAG | 126 |
| y230 | oMS2-R | CAGGTCAAACCTCCTAGGAATG | 127 |
| y470 | opUC19Δ1-F | AGTGTAAAGCCTGGGGTGCCT | 128 |
| y471 | opUC19Δ1-R | TGACTGGGAAAACCCTGGCGT | 129 |
| y472 | opUC19Δ2-F | ATTGCGTTGCGCTCACTGCC | 130 |
| y473 | opUC19Δ2-R | GCCCTTCCCAACAGTTGCG | 131 |

TABLE 6-continued

| num | name | sequence | SEQ ID NO. |
|---|---|---|---|
| y474 | oNL43_A0_inner-F | TTGTAAAACGACGGCCAGTGAATTCGAGCTCGGTACCCGGAGGCCTCCACCTGGGTCTTG | 132 |
| y475 | oNL43_A0_outer-F | GCGGCCGCAGGCGATTAAGTTGGGTAACGCCAGGGTTTTCCCAGTCACGGCGCGCCTTGTAAAACGACGGCCAGTGAATTC | 133 |
| y476 | oNL43_A0-R | GCGGCCGCAGGCCCTGCATGCACTGGATGCAATCTATCCCATTCTGCA | 134 |
| y477 | oNL43_B0-F | GCGGCCGCTGCAGAATGGGATAGATTGCATCCAGTGCATGCAGGGCCT | 135 |
| y478 | oNL43_B0-R | GCGGCCGCAGCTGTCCTTTTCTGGCAGCACTATAGGCTGTACTGTCCA | 136 |
| y479 | oNL43_C0-F | GCGGCCGCTGGACAGTACAGCCTATAGTGCTGCCAGAAAAGGACAGCT | 137 |
| y480 | oNL43_C0_inner-R | CATTAGGCACCCCAGGCTTTACACTGGCGCGCCATCTTGTATTACTACTGCCCCTTCACCTTTCCAGAGGAGC | 138 |
| y481 | oNL43_C0_outer-R | GCGGCCGCGTGAGTTAGCTCACTCATTAGGCACCCCAGGCTTTACACT | 139 |
| y482 | oNL43_D0-F | AGGCGATTAAGTTGGGTAACGCCAGGGTTTTCCCAGTCACGGCGCGCCGCTCCTCTGGAAAGGTGAAGGGGCAGTAGTAATACAAGAT | 140 |
| y483 | oNL43_D0-R | GTGAGTTAGCTCACTCATTAGGCACCCCAGGCTTTACACTGGCGCGCCCATTTACCAATACTACTTCTTGTGGGTTGGGGTCTGTGGG | 141 |
| y484 | oNL43_E0_inner-F | GTAACGCCAGGGTTTTCCCAGTCACGGCGCGCCCCCACAGACCCCAACCCACAAGAAGTAGTATTGGTAAATG | 142 |
| y485 | oNL43_E0_outer-F | GCGGCCGCAGGCGATTAAGTTGGGTAACGCCAGGGTTTTCCCAGTCAC | 143 |
| y486 | oNL43_E0-R | GCGGCCGCGCACAGGCTCCGCAGATCGTCCCAGATAAGTGCTAAGGAT | 144 |
| y487 | oNL43_F0-F | GCGGCCGCATCCTTAGCACTTATCTGGGACGATCTGCGGAGCCTGTGC | 145 |
| y488 | oNL43_F0-R | GCGGCCGCGCAGCTCTCGGGCCACGTGATGAAATGCTAGGCGGCTGTC | 146 |
| y489 | oNL43_G0-F | GCGGCCGCGACAGCCGCCTAGCATTTCATCACGTGGCCCGAGAGCTGC | 147 |
| y490 | oNL43_G0_inner-R | TGATTACGCCAAGCTTGCATGCCTGCAGGTCGACTCTAGAGCGCGATCTTGGCTCACTGC | 148 |
| y491 | oNL43_G0_outer-R | GCGGCCGCGTGAGTTAGCTCACTCATTAGGCACCCCAGGCTTTACACTGGCGCGCCTGATTACGCCAAGCTTGCATGCCTG | 149 |
| y661 | oNL43_AB-F | GCATCCAGTGCATGCAGGGCCT | 150 |
| y662 | oNL43_BC-R | CTGGCAGCACTATAGGCTGTACTGTCCA | 151 |
| y663 | oNL43_BC-F | TGGACAGTACAGCCTATAGTGCTGCCAG | 152 |
| y664 | oNL43_CD-R | CTACTGCCCCTTCACCTTTCCAGAGGAGC | 153 |
| y665 | oNL43_CD-F | GCTCCTCTGGAAAGGTGAAGGGGCAGTAG | 154 |
| y666 | oNL43_DE-R | CTACTTCTTGTGGGTTGGGGTCTGTGGG | 155 |
| y667 | oNL43_DE-F | CCCACAGACCCCAACCCACAAGAAGTAG | 156 |
| y668 | oNL43_EF-R | GGCTCCGCAGATCGTCCCAGATAAGTGC | 157 |
| y669 | oNL43_EF-F | GCACTTATCTGGGACGATCTGCGGAGCC | 158 |
| y670 | oNL43_FG-R | GGCCACGTGATGAAATGCTAGGCGGC | 159 |
| y671 | oNL43_FG-F | GCCGCCTAGCATTTCATCACGTGGCC | 160 |

TABLE 6-continued

| num | name | sequence | SEQ ID NO. |
|---|---|---|---|
| y672 | oNL43_gag MA_178 bp-F | TGGGACAGCTACAACCATCCCT | 161 |
| y673 | oNL43_gag MA_178 bp-R | GCTGCTGCTTGCTGTGCCTT | 162 |

Linearized vectors were prepared by 15 cycles of PCR using 1 ng of pUC19 as template with Q5. pUC19Δ1 was obtained by PCR with oligos y470 and y471. pUC19Δ2 was obtained by PCR with oligos y472 and y473 that had been 5' phosphorylated with T4 PNK (New England Biolabs). pUC19Bam was obtained by PCR with oligos y541 and y542. After the cycling was completed, each reaction was supplemented with 20 U of DpnI (New England Biolabs), mixed, then incubated for 1 h at 37° C. to eliminate template DNA, then purified by a silica column cleanup with Zymo DCC-5 (Zymo Research, DCC-5). The NL43-WT cloning PCR scheme is provided below in Table 7.

TABLE 7

NL43-WT-cloning-PCR-scheme

| name | size | template | fwd olig. | rev olig. |
|---|---|---|---|---|
| pUC19Δ1 | 2522 | pUC19/BamHI | y470 | y471 |
| pUC19Δ2 | 2384 | pUC19/BamHI | y472 + $P_i$ | y473 + $P_i$ |
| pUC19Bam | 2684 | pUC19/BamHI | y541 | y542 |
| NL43_A00_inner | 1788 | pNL4-3/EcoRI | y474 | y476 + $P_i$ |
| NL43_A00 | 1844 | NL43_A00_inner | y475 + $P_i$ | y476 + $P_i$ |
| NL43_B00 | 1904 | pNL4-3/EcoRI | y477 + $P_i$ | y478 + $P_i$ |
| NL43_C00_inner | 1766 | pNL4-3/EcoRI | y479 + $P_i$ | y480 |
| NL43_C00 | 1789 | NL43_C00_inner | y479 + $P_i$ | y481 + $P_i$ |
| NL43_D00 | 1633 | pNL4-3/EcoRI | y482 + $P_i$ | y483 + $P_i$ |
| NL43_E00_inner | 2102 | pNL4-3/BamHI | y484 | y486 + $P_i$ |
| NL43_E00 | 2125 | NL43_E00_inner | y485 + $P_i$ | y486 + $P_i$ |
| NL43_F00 | 931 | pNL4-3/EcoRI | y487 + $P_i$ | y488 + $P_i$ |
| NL43_G00_inner | 453 | pNL4-3/BamHI | y489 + $P_i$ | y490 |
| NL43_G00 | 509 | NL43_G00_inner | y489 + $P_i$ | y491 + $P_i$ |

Three of the seven single-block inserts (NL43_B00, NL43_D00 and NL43_F00) were amplified by 15 cycles of PCR using 1 ng of BamHI- or EcoRI-cut pNL4-3 as template and the oligos listed in Table 6. Post-thermocycling, each reaction was supplemented with 20 U of DpnI (New England Biolabs), mixed, then incubated for 1 h at 37° C. to eliminate template DNA, then purified by a silica column cleanup with Zymo DCC-5 (Zymo Research, DCC-5).

The remaining four single-block inserts (NL43_A00, NL43_C00, NL43_E00, NL43_G00) were amplified by two rounds of PCR, using the oligos listed in Table 6. An "inner" PCR product was obtained by 15 cycles of PCR using 1 ng of EcoRI-cut pNL4-3 as template. The final linear product was obtained by an additional 10 cycles of PCR, using 0.5 µl of the "inner" PCR product as template in a new 50 µl PCR reaction. Post-thermocycling, each reaction was supplemented with 20 U of Dpn*I (New England Biolabs), mixed, then incubated for 1 h at 37° C. to eliminate template DNA, then purified by a silica column cleanup with Zymo DCC-5 (Zymo Research, DCC-5).

Single-block plasmids were constructed by TA-cloning. Linearized vectors (pUC19Δ1 and pUC19Δ1) were 3' dA-tailed by incubating 2 µg linear vector DNA, 200 µM dATP, 15 U of Klenow Fragment (exo⁻) (New England Biolabs), in a 50 µl reaction in 1×NEB Buffer 2 for 2 h at 37° C. DNA was purified from the reaction by DCC-5 silica column cleanup (Zymo Research). The seven wildtype inserts (NL43_A00, NL43_B00, . . . , NL43_G00) were 3' dT-tailed by incubating 2 µg insert DNA, 200 µM dTTP, 15 U of Klenow Fragment (exo⁻) (New England Biolabs), in a 50 µl reaction in 1×NEB Buffer 2 for 2 hours at 37° C. DNA was purified from the reaction by DCC-5 silica column cleanup (Zymo Research).

All ligations were performed using T4 DNA Ligase (New England Biolabs, Quick Ligation Kit, #M2200L). To construct pUC19Δ1-NL43_D00, 50 ng of 3' dT-tailed NL43_D00 were ligated into 50 ng of 3' dA-tailed pUC19Δ1 in a 20 µl reaction for 30 min at 25° C.

To construct the remaining six single-block wildtype plasmids (-NL43_x, where x is one of {A00,B00,C00,E00,F00,G00}), 50 ng of 3' dT-tailed NL43_x were ligated into 50 ng of 3' dA-tailed in a 20 µl reaction for 30 min at 25° C.

Chemically competent DH10B E. coli were transformed with the ligation mixture, recovered for 1 hour at 37° C., then plated on LB plates supplemented with 100 µg/ml carbenicillin and grown overnight at 37° C. Single colonies were obtained and plasmids characterized by Sanger sequencing across the insert region and diagnostic restriction digests. All wildtype single-block plasmids are enumerated in Table 3.

Construction of Mutant Single-Block Plasmids

Deletion mutant pieces were ordered as synthetic dsDNA molecules (Integrated DNA Technologies, gBlocks). A total of 13 mutant blocks were ordered (7× B-blocks (B01, B02, B03, B04, B05, B06, B07), 1×C-block (001), 4×D-blocks (D01, D02, D03, D04), and 1×F-block (F01)).

Mutant blocks NL43_D01, NL43_D02, NL43_D03, and NL43 DO4 were cloned into pUC19Δ1 linear PCR product by Gibson Assembly (Gibson Assembly HiFi 1-Step Kit, SGI-DNA) via the manufacturer's protocol. The remaining 9 mutant blocks (NL43_B01, . . . , NL43_F01) were cloned into pUC19Δ2 linear PCR product by Gibson Assembly (Gibson Assembly HiFi 1-Step Kit, SGI-DNA). After a 1 hour incubation at 50° C., the 10 µl Gibson Assembly reactions were diluted by adding 50 µl of TE. One µl of the diluted mix was used to transform 40 µl of electrocompetent DH10B E. coli. The transformations were recovered for 1 hour at 37° C., then plated on LB plates supplemented with 100 µg/ml carbenicillin and grown overnight at 37° C. Single colonies were obtained and plasmids characterized by Sanger sequencing across the insert region and diagnostic restriction digests. All single-block plasmids are enumerated in Table 8.

TABLE 8

NL4-3-singlePiecePlasmids

| name | size | insert | backbone | enzyme |
| --- | --- | --- | --- | --- |
| pUC19Δ2-NL43_A00 | 4229 | 1836 | 2394 | NotI |
| pUC19Δ2-NL43_B00 | 4290 | 1896 | 2394 | NotI |
| pUC19Δ2-NL43_B01 | 3334 | 935 | 2394 | NotI |
| pUC19Δ2-NL43_B02 | 2989 | 590 | 2394 | NotI |
| pUC19Δ2-NL43_B03 | 2803 | 404 | 2394 | NotI |
| pUC19Δ2-NL43_B04 | 3442 | 1043 | 2394 | NotI |
| pUC19Δ2-NL43_B05 | 3525 | 1126 | 2394 | NotI |
| pUC19Δ2-NL43_B06 | 3490 | 1091 | 2394 | NotI |
| pUC19Δ2-NL43_B07 | 3554 | 1155 | 2394 | NotI |
| pUC19Δ2-NL43_C00 | 4174 | 1781 | 2394 | NotI |
| pUC19Δ2-NL43_C01 | 3250 | 857 | 2394 | NotI |
| pUC19Δ1-NL43_D00 | 4076 | 1545 | 2531 | AscI |
| pUC19Δ1-NL43_D01 | 622 | 622 | 2531 | AscI |
| pUC19Δ1-NL43_D02 | 561 | 561 | 2531 | AscI |
| pUC19Δ1-NL43_D03 | 519 | 519 | 2531 | AscI |
| pUC19Δ1-NL43_D04 | 397 | 397 | 2531 | AscI |
| pUC19Δ2-NL43_E00 | 4510 | 2117 | 2394 | NotI |
| pUC19Δ2-NL43_F00 | 3317 | 923 | 2394 | NotI |
| pUC19Δ2-NL43_F01 | 3205 | 812 | 2394 | NotI |
| pUC19Δ2-NL43_G00 | 2895 | 501 | 2394 | NotI |

Construction of 3-Block Plasmids

To construct plasmids harboring subassemblies of 3 blocks (ABC or EFG as shown in FIG. 39, single blocks were liberated from their respective plasmids by digestion and gel-purified from plasmid backbone. To assemble ABC 3-block plasmids, a pool of liberated A,B,C blocks were combined with linear pUC19Δ1 and incubated for 1 hour at 50° C. in Gibson Assembly master mix (Gibson Assembly HiFi 1-Step Kit, SGI-DNA). To assemble EFG 3-block plasmids, a pool of liberated E,F,G blocks were combined with linear pUC19Δ2 and incubated for 1 hour at 50° C. in Gibson Assembly master mix (Gibson Assembly HiFi 1-Step Kit, SGI-DNA).

After a 1 hour incubation at 50° C., the 10 μl Gibson Assembly reactions were diluted by adding 50 μl of TE. One μl of the diluted mix used to transform 40 μl of electrocompetent DH10B E. coli.

The transformations were recovered for 1 hour at 37° C., then plated on LB plates supplemented with 100 μg/ml carbenicillin and grown overnight at 37° C. Single colonies were obtained and plasmids characterized by Sanger sequencing across junction regions joined by Gibson Assembly and diagnostic restriction digests.

Construction of 7-Block Plasmids (Full-Length Virus)

3-block inserts (ABC and EFG) were liberated from 3-block plasmids by digestion with AscI and gel-purified from the backbone. D blocks were liberated by digestion of 1-block D plasmids. A three-insert Gibson assembly was performed by combining an ABC 3-block insert, a D-block insert, and a EFG 3-block insert with pUC19Bam and incubated 1 hour at 50° C. in Gibson Assembly master mix (Gibson Assembly HiFi 1-Step Kit, SGI-DNA) per the manufacturer's instruction.

After a 1 hour incubation at 50° C., the 10 μl Gibson Assembly reactions were diluted by adding 50 μl of TE. One μl of the 1:5 diluted mix used to transform 40 μl of electrocompetent DH10B E. coli.

The transformations were recovered for 90 min at 30° C., then plated on LB plates supplemented with 25 μg/ml carbenicillin and grown overnight at 32° C. Single colonies were obtained and plasmids characterized by Sanger sequencing across junction regions joined by Gibson Assembly. Diagnostic restriction digests were also performed to confirm that the 7-block plasmids had the correct topology. All 7-block plasmids (full-length virus) are listed in Table 5.

Characterization of Deletion Mutants

Deletion mutants were assayed for three properties: replication-competence (can spread without wildtype virus), interfere with WT virus (by competing for common goods or another mechanism), and mobilized by the wildtype virus (efficiently trans-complemented. Supercoiled plasmid stocks of the mutant library were arrayed in 96-well plate format at a normalized DNA concentration (33 ng/). The collection of deletion mutants used the same vector backbone as the wildtype HIV-1 and had similar sizes (9-12 kbp mutants compared to 15 kbp wildtype). A related HIV-1 molecular clone (NLENG1-IRES), which we refer to as NL43G was used as positive control. NL43G is tagged with EGFP in the nef locus. Productively infected cells can be visualized by GFP fluorescence after approximately 20 hours of infection.

Production of Virus and Pseudovirus Stocks

Virus pools were obtained by co-transfection of 293T with one or more plasmids. On the day of transfection, a suspension of 293T was obtained by trypsinization of subconfluent 15-cm plates of 293T and brought into single cell suspension by gentle passage through a 40 μm mesh filter (Corning). A cell count was obtained with an automated Coulter cell counter (Moxi, ORFLO), and cells were diluted to a concentration of $5 \cdot 10^5$ cells/ml in D10. Two ml of this suspension ($10^6$ cells) were added to each well of a series of 6-well polystyrene tissue culture plates.

Transfection complexes were prepared in 96-well polypropylene PCR plates under sterile conditions. A total of 2 μg of supercoiled plasmid DNA in (10 mM Tris-Cl, pH 8.0; 0.1 mM EDTA, pH 8.0) was added to each well and the volume brought to 100 μl by the addition of serum-free DMEM supplemented with 25 mM HEPES. Next, 106 μg of a mixture comprised of 100:6 (v:v) of serum free-DMEM supplemented with 25 mM HEPES and 1 mg/ml polyethyleneimine (PEI) in $dH_2O$ (prepared from 25 kDa linear PEI; Polysciences #23966-1) were added and the contents mixed by pipetting up and down 15× with the multichannel pipette volume set to 106 μl. The transfection mixture was incubated at room temperature (24° C.) for 15 min, then the contents of each well in the 96-well plate added to a corresponding well of $10^6$ 293T prepared above. The 6-well plates were gently rocked to distribute the transfection complexes, and then placed in a humidified 37° C. incubator with a 95% air/5% $CO_2$ atmosphere. At 16 h post-transfection, the culture media was aspirated and replaced with 2.5 ml of D10. At 43-48 hours post-transfection, the virus-containing media was harvested and clarified by passage through a 0.45 μm sterile filter (Millipore). The filtrate was immediately used to infect target cells.

Determination of Replication Competence

Virus stocks were prepared as described above, where the 2 μg mass of plasmid DNA in each well was comprised entirely of a single HIV-1 molecular clone or deletion mutant. An EGFP-tagged molecular clone (pNLENG1-IRES), which encodes NL4-3 with an EGFP::IRES::nef cassette in the nef locus was used as a positive control for replication competence (Levy, D. N. et al. *PNAS*, 101, 4204-4209 (2004)). We refer to this clone as NL43G for simplicity.

MT-4 (Miyoshi, I. et al. *Gann. Monogr.*, 28 (1982)), (a highly-permissive, highly-susceptible T cell line) were infected with the prepared viral stocks in a 96-well U-bottom plate format. All infections were performed in duplicate. In each well, $10^5$ MT-4 in 150 μl of R10 were mixed with 50 μl of virus stock by pipetting up and down 4×, and then returned to a 37° C. incubator. Cultures were split 1:10 with fresh media every 3-4 days and the wells assayed for infection visually (for cytopathic effect/cell lysis) at each split.

At 5 days post-infection, 90 μl of the cell mixture from each well were transferred to a 96-well opaque plastic plate (OptiPlate96-F, PerkinElmer) and mixed with 10 μl of PrestoBlue Cell Viability Reagent (ThermoFisher, #A13261). The plate was sealed with a gas-permeable adhesive seal (ThermoFisher, #AB0718) and incubated for 90 min at 37° C. The reaction was quenched and virus inactivated by addition of 50 μl of 3% (m/v) SDS solution to each well. Fluorescence was read on an EnSpire Plate Reader (PerkinElmer) with the monochromator set to excitation/emission wavelengths of 560/590 nm.

At 5 days post-infection, the MT-4 were assessed for viability visually and by a metabolic assay (PrestoBlue), which detects live, metabolically active cells that have a functional electron transport chain. Thus, wells infected with replication-competent virus will be mostly killed (based on live cell data), and have a low metabolic activity, which is detectable by low fluorescence signal in the plate reader assay.

Interference Assay by Co-Transfection

Virus stocks were prepared as described above, but the 2 μg mass of plasmid DNA in each well was comprised of 1 μg of a single HIV-1 molecular clone or deletion mutant and 1 μg of pNLENG1-IRES.

MT-4 cells were infected with the prepared viral stocks in a 96-well U-bottom plate format. All infections were performed in duplicate. In each well, $10^5$ MT-4 in 150 μl of R10 were mixed with 50 μl of virus stock by pipetting up and down 4×, and then returned to a 37° C. incubator.

At 24 and 48 hours post-infection, cells were resuspended and 50 μl (25% of the volume) removed for analysis by flow cytometry. The 50 μl sample was fixed by addition of 0.1 volumes of a 20% formaldehyde solution (tousimis, #1008A) and incubated for at least 1 hour at 4° C. before cytometry. Cells were scored for EGFP-expression by analyzing a portion of each sample on an HTFC IntelliCyt flow cytometer (488 nm excitation, 530/30 nm bandpass emission).

The cell population was scored for GFP+ cells by flow cytometry at 24 and 48 hpi. All mutants are untagged: the only source of GFP production is infection with wildtype NL43G virus. If a mutant does not interfere with WT virus replication, than the presence or absence of the subgenomic mutant will not affect GFP+levels. Conversely, if we observe a change in GFP+ compared to wildtype (NL43G only), the mutant either enhances wildtype virus replication (higher levels of GFP+ cells) or interferes (decreases levels of GFP+cells).

Assay for Mobilization from 293T

Cloned mutants were tested for transmissibility: could they be encapsidated and transmitted by supply the missing trans-acting elements via transfection. A packaging cell line (239T) was co-transfected with the mutant viral genome plasmid and two additional plasmids: a packaging plasmid (pCMVRΔ8.91), which provides several HIV-1 proteins in trans (Gag, Pol, Tat, Rev), but is not replication-competent), and an envelope pseudotyping plasmid which provides a pan-tropic VSV-G envelope protein (pMD.G).

Virus stocks were prepared as described above, but the 2 μg mass of plasmid DNA in each well was comprised of 500 ng of a single HIV-1 molecular clone or deletion mutant, 500 ng of a VSV-G pseudotyping plasmid (pMD.G from Naldini, L. *Science* 272, 263-7 (1996)), and 1000 ng of a 2nd generation lentivirus packaging plasmid (pCMVRΔ8.91 from Zufferey, R. et al. *Nature Biotechnology*, 15, 871-5, (1997)). 48 hours post-transfection of 293T, virus-containing supernatant was harvested, clarified, and used to transduce a T-cell line (MT-4), and the cells allowed to recover and outgrow for 5 days.

MT-4 cells were transduced/infected with the prepared viral stocks in a 96-well U-bottom plate format. All infections were performed in duplicate. In each well, $10^5$ MT-4 in 150 μl were mixed with 50 μl of virus stock by pipetting up and down 4×, and then returned to a 37° C. incubator. Cultures were split 1:10 with fresh R10 media every 3-4 days and the wells assayed for infection visually (for cytopathic effect/cell lysis) at each split.

At 5 days post-infection, the transduced cells were washed 2× in 700 μl DPBS and genomic DNA isolated from the cell pellet using a commercial kit (Macherey-Nagel, NucleoSpin Blood). Each transduced culture was assessed for transduction efficiency by performing PCR with primers specific to block B and block D, using DNA isolated from the transduced cells as template.

PCR of gDNA isolated from transduced MT-4 was performed to test for transduction/mobilization of DIP candidates. Block B was amplified by PCR from gDNA template with oligos oNL43_AB-F and oNL43_BC-R. Block D was amplified by PCR from gDNA template with oligos oNL43_CD-F and oNL43_DE-R. PCR reactions were performed with OneTaq DNA Polymerase (New England Biolabs, #M0480L). Each 20 μl PCR reaction consisted of 2.0 μl template DNA, 0.4 μl of 10 μM forward oligo, 0.4 μl of 10 μM reverse oligo, 0.4 μl of 10 mM dNTP, 4.0 μl of 5× OneTaq DNA Polymerase Reaction Buffer, 0.1 μl OneTaq DNA Polymerase (5 U/μl), and 12.7 μl dH$_2$O. Thermocycling conditions (in mm:ss format) were (1 cycle of 95° C. for 5:00; 35 cycles of 94° C. for 0:15, 61° C. for 0:30, 68° C. for 1:30; 1 cycle of 68° C. for 5:00; 1 cycle of 10° C. for HOLD).

Results

Determination of Replication Competence

Figure 42:
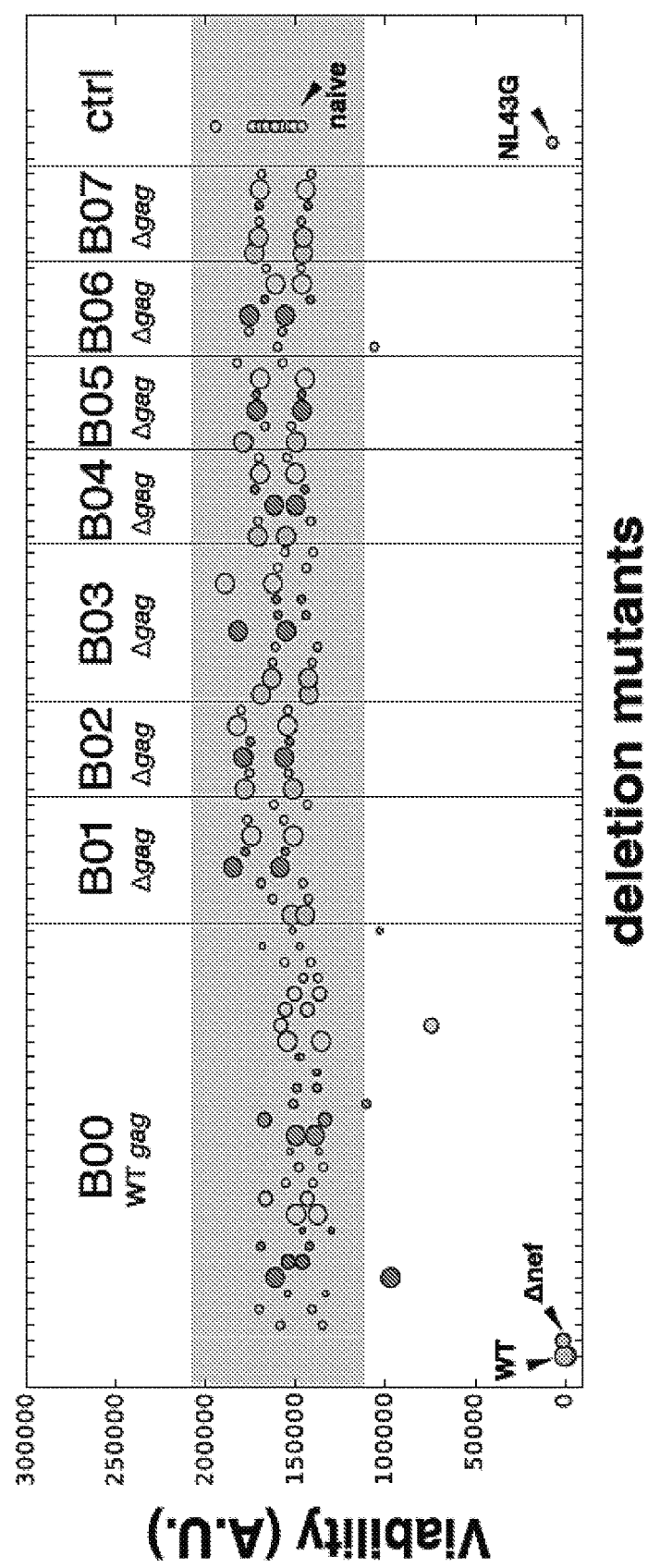

As shown in FIG. 42 and FIG. 43, the only clones for which cell killing is evident are NL43G (WT control), the A00B000C00D00E00F00G00 mutant (WT genotype) and a mutant with a single deletion in nef-deletion mutant (F01). This is consistent with literature reports, as nef is dispensable for replication of certain strains of HIV-1 in permissive cells lines, such as MT-4. Thus, this validates that the cloning strategy employed can reconstruct viruses with full wildtype activity.

No loss in cell viability was observed for the other 59 of 61 molecular clones, which contain deletions in one or more essential trans-acting elements. These cultures were outgrown and inspected visually for up to 14 days, but no cytopathic effect of loss of viability was observed in the remaining 59 mutants (data not shown).

Thus, the 59 deletion mutants are not replication-competent and must be trans-complemented by wildtype virus to transmit.

Interference Assay by Co-Transfection

Results of the interference assay are shown in FIG. 44, FIG. 45, FIG. 46, FIG. 47 and FIG. 48.

At 24 hpi (FIG. 44, FIG. 45, FIG. 46), 13-17% of cells were GFP$^+$ in the control NL43G infection, compared to <1% in the uninfected control (naïve). Co-transfection with the reconstituted replication-competent HIV-1 clones had little effect on single-round wildtype HIV-1 NL43G replication (WT: 11-15% GFP$^+$, Δnef. 11-13% GFP$^+$).

In contrast, many of the multiply deleted clones showed strong interference with wildtype HIV-1 replication, eliciting 0.5 $\log_{10}$-1.0 $\log_{10}$ reductions in infectious titer with respect to wildtype. The strongest interference effect was observed in clones harboring both deletions in gag and deletions in the accessory tract of the HIV-1 genome (vif-vpu). With no deletions in gag (B00), few of the clones exhibiting strong interference, except for those that also had deletions in pol and nef. No clones showed any consistent enhancement of HIV-1 infection, as defined by an average increase of >30%).

At 24 hpi, the presence (FIG. 46) or absence (FIG. 44 and FIG. 45) of an HIV-1 protease inhibitor (Darunavir) did not affect the percentage of infected cells, reflecting that 24 hpi was appropriate timing to conduct single round studies of HIV-1 replication.

By 48 hpi, (FIG. 47 and FIG. 48), an additional round of HIV-1 replication will have occurred and interference effects will be easily detectable. As before, the strongest interference was observed in clones harboring both deletions in gag and deletions in the accessory tract of the HIV-1 genome (vif-vpu). With no deletions in gag (B00), few of the clones exhibit strong interference, except for those that also had deletions in pol and nef. Again, no clones showed consistent enhancement of HIV-1 infection as defined by an average increase of >30%.

Table 9 (see FIG. 50) serves as map between the data in FIGS. 43, 45, 48 and the sequence associated with each pair of 76 datapoints. In these figures, there are 76 pairs of blue dots moving left to right across the plot, a vertical line, then two pairs of green dots reflecting the controls. Table 9 identifies the mutants that are "replicating" or "not-replicating" (FIG. 43), or "interfering"/"not-interfering" (FIGS. 45 and 48). Some sequences are listed more than once because they had more than one associated bacterial strain (Table 5). The classification is dependent on whether the mean of the pair of points falls within/outside the gray rectangle in the plots.

Table 10 below classifies each of the unique 61 "hiv" sequences as replicating/not-replicating or interfering/not interfering by removing duplicate sequences*.

TABLE 10

| FIG. 43 | | FIG. 45 | | FIG. 48 | |
|---|---|---|---|---|---|
| replicates | does not replicate | interferes | does not interfere | interferes | does not interfere |
| 2 of 61 | 59 of 61 | 48 of 61 | 13 of 61 | 45 of 61 | 17 of 61 |
| hiv00 | hiv09 | hiv54 | hiv38 | hiv54 | hiv01 |
| hiv01 | hiv19 | hiv11 | hiv29 | hiv58 | hiv53 |
| | hiv02 | hiv58 | hiv01 | hiv44 | hiv19 |
| | hiv16 | hiv47 | hiv26 | hiv47 | hiv38 |
| | hiv52 | hiv44 | hiv00 | hiv55 | hiv51 |
| | hiv17 | hiv60 | hiv04 | hiv31 | hiv29 |
| | hiv13 | hiv49 | hiv05 | hiv11 | hiv05 |
| | hiv14 | hiv42 | hiv09 | hiv60 | hiv04 |
| | hiv18 | hiv55 | hiv08 | hiv42 | hiv26 |
| | hiv04 | hiv10 | hiv06 | hiv21 | hiv17 |
| | hiv11 | hiv28 | hiv07 | hiv28 | hiv00 |
| | hiv06 | hiv31 | hiv03 | hiv49 | hiv09 |
| | hiv15 | hiv15 | hiv02 | hiv37 | hiv08 |
| | hiv08 | hiv21 | | hiv27 | hiv06 |
| | hiv10 | hiv27 | | hiv23 | hiv03 |
| | hiv37 | hiv14 | | hiv56 | hiv02 |
| | hiv20 | hiv23 | | hiv48 | hiv07 |
| | hiv35 | hiv37 | | hiv24 | |
| | hiv03 | hiv48 | | hiv32 | |
| | hiv07 | hiv56 | | hiv45 | |
| | hiv36 | hiv24 | | hiv14 | |

TABLE 10-continued

| FIG. 43 | | FIG. 45 | | FIG. 48 | |
|---|---|---|---|---|---|
| replicates | does not replicate | interferes | does not interfere | interferes | does not interfere |
| | hiv25 | hiv45 | | hiv10 | |
| | hiv23 | hiv32 | | hiv30 | |
| | hiv32 | hiv52 | | hiv15 | |
| | hiv51 | hiv33 | | hiv36 | |
| | hiv53 | hiv30 | | hiv52 | |
| | hiv05 | hiv59 | | hiv25 | |
| | hiv60 | hiv36 | | hiv59 | |
| | hiv39 | hiv13 | | hiv33 | |
| | hiv12 | hiv22 | | hiv46 | |
| | hiv41 | hiv46 | | hiv35 | |
| | hiv59 | hiv25 | | hiv22 | |
| | hiv54 | hiv12 | | hiv13 | |
| | hiv57 | hiv34 | | hiv43 | |
| | hiv46 | hiv57 | | hiv50 | |
| | hiv56 | hiv16 | | hiv40 | |
| | hiv58 | hiv18 | | hiv34 | |
| | hiv42 | hiv35 | | hiv12 | |
| | hiv45 | hiv50 | | hiv57 | |
| | hiv48 | hiv43 | | hiv39 | |
| | hiv55 | hiv39 | | hiv18 | |
| | hiv47 | hiv40 | | hiv16 | |
| | hiv40 | hiv19 | | hiv41 | |
| | hiv43 | hiv17 | | hiv20 | |
| | hiv22 | hiv20 | | hiv19 | |
| | hiv38 | hiv41 | | | |
| | hiv30 | hiv53 | | | |
| | hiv44 | hiv51 | | | |
| | hiv29 | | | | |
| | hiv26 | | | | |
| | hiv50 | | | | |
| | hiv24 | | | | |
| | hiv31 | | | | |
| | hiv27 | | | | |
| | hiv28 | | | | |
| | hiv33 | | | | |
| | hiv49 | | | | |
| | hiv21 | | | | |
| | hiv34 | | | | |

*For the hiv19 sequence, one of the "hiv19" clones was classified as "interfering" and the other was classified as "non-interfering".

Assay for Mobilization from 293T

As shown in FIG. 49, the appearance of distinct PCR products at a length less than the WT Block B (1.9 kbp) or WT Block D (1.5 kbp), indicates that MT-4 cells were successfully transduced with the deletion mutant (indicating mobilization) and that the mutant did not lead to cell death (as occurred in some control reactions). For this reason, BTN503 (reconstituted wildtype) and BTN504 (Δnef) showed weak amplification, as the cells were destroyed by viral infection. Approximately 50% (31 of 61) of the deletion mutants showed clear mobilization from 293T from co-transfection.

SEQUENCE LISTING (181 sequences)

SEQ ID NO: 1 - DNA, 26 bp, Artificial Sequence
  Synthetic sequence
aactataacggtcctaaggtagcgaa

SEQ ID NO: 2 - DNA, 26 bp, Artificial Sequence
  Synthetic sequence
aactataacggtcctaaggtagcgaa

SEQ ID NO: 3 - DNA, 3984 bp, Artificial Sequence
  Synthetic sequence
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcgagctcggtacccgggctgtctcttatacacatctgcggccgctagggataacagggtaatttagttagttagttaactataacggtcctaaggtagcgaaagatcttaagtaagtaagagtatacgtatatcggctaataacgtattaaggcgcttcggcgcctttttttatgggggtattttcatcccaatccacacgtccaacgcacagcaaacaccacgtcgaccctatcagctgcgtgctttctatgagtcgttgctgcataacaaaaaatttatttgcttattaattcatccggctcgtataatgtgtggagggcccaagttcacttaaaaaggagatcaacaatgaaagcaattttcgtactgaaacatcttaatcatgctaaggaggttttctatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaaggatcggttgtcgagtaaggatctccaggcatcaaataaaacgaaaggctcagtcgaaagactgggcctttcgttttatctgttgtttgtcggtgaacgctctctactagagtcacactggctcaccttcgggtgggcctttctgcgtttataggatcctaactcgagtagggataacagggtaatttagttagttagttaactataacggtcctaaggtagcgaattaattaaagatgtgtataagagacaggatcctctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 4 - DNA, 4121 bp, Artificial Sequence
  Synthetic sequence
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcgagctcggtacccgggctgtctcttatacacatctgcggccgctagggataacagggtaatttagttagttagttaactataacggtcctaaggtagcgaaagatcttaagtaagtaagagtatacgtatatcggctaataacgtattaaggcgcttcggcgcctttttttatgggggtattttcatcccaatccacacgtccaacgcacagcaaacaccacgtcgaccctatcagctgcgtgctttctatgagtcgttgctgcataacaaaaaatttatttgcttattaattcatccggcttcgtataatgtgtggagggcccaagttcacttaaaaaggagatcaacaatgaaagcaattttcgtactgaaacatcttaatcatgctaaggaggttttctaatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctaaggatcggttgtcgagtaaggatctccaggcatcaaataaaacgaaaggctcagtcgaaagactgggcctttcgttttatctgttgtttgtcggtgaacgctctctactagagtcacactggctcaccttcgggtgggcctttctgcgtttataggatcctaactcgagtagggataacagggtaatttagttagttagttaactataacggtcctaaggtagcgaattaattaaagatgtgtataagagacaggatcctctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 5 - DNA, 1298 bp, Artificial Sequence
  Synthetic sequence
ctgtctcttatacacatctgcggccgctagggataacagggtaatttagttagttagttaactataacggtcctaaggtagcgaaagatcttaagtaagtaagagtatacgtatatcggctaataacgtattaaggcgcttcggcgcctttttttatgggggtattttcatcccaatccacacgtccaacgcacagcaaacaccacgtcgaccctatcagctgcgtgctttctatgagtcgttgctgcataacaaaaaatttatttgcttattaattcatccggctcgtataatgtgtggagggcccaagttcacttaaaaaggagatcaacaatgaaagcaattttcgtactgaaacatcttaatcatgctaaggaggttttctatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaaggatcggttgtcgagtaaggatctccaggcatcaaataaaacgaaaggctcagtcgaaagactgggcctttcgttttatctgttgtttgtcggtgaacgctctctactagagtcacactggctcaccttcgggtgggcctttctgcgtttataggatcctaactcgagtagggataacagggtaatttagttagttagttaactataacggtcctaaggtagcgaattaattaaagatgtgtataagagacag

SEQ ID NO: 6 - DNA, 1435 bp, Artificial Sequence
  Synthetic sequence
ctgtctcttatacacatctgcggccgctagggataacagggtaatttagttagttagttaactataacggtcctaaggtagcgaaagatcttaagtaagtaagagtatacgtatatcggctaataacgtattaaggcgcttcggcgcctttttttatgggggtattttcatcccaatccacacgtccaacgcacagcaaacaccacgtcgaccctatcagctgcgtgctttctatgagtcgttgctgcataacaaaaaatttatttgcttattaattcatccggcttcgtataatgtgtggagggcccaagttcacttaaaaaggagatcaacaatgaaagcaattttcgtactgaaacatcttaatcatgctaaggaggttttctaatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctaaggatcggttgtcgagtaaggatctccaggcatcaaataaaacgaaaggctcagtcgaaagactgggcctttcgttttatctgttgtttgtcggtgaacgctctctactagagtcacactggctcaccttcgggtgggcctttctgcgtttataggatcctaactcgagtagggataacagggtaatttagttagttagttaactataacggtcctaaggtagcgaattaattaaagatgtgtataagagacag

SEQ ID NO: 7 - DNA, 20 bp, Artificial Sequence
  Synthetic sequence
  Misc_feature (1)..(1): There is a phosphate group at the 5' end
ccgtccatgaagggttcgat

SEQ ID NO: 8 - DNA, 20 bp, Artificial Sequence
  Synthetic sequence
  Misc_feature (1)..(1): There is a phosphate group at the 5' end
acgaatctgccgttgccata

SEQ ID NO: 9 - DNA, 60 bp, Artificial Sequence
  Synthetic sequence
  misc_feature (21)..(40): n is a, c, g, or t
ccgtccatgaagggttcgatnnnnnnnnnnnnnnnnnnnntatggcaacggcagattcgt

SEQ ID NO: 10 - DNA, 20 bp, Artificial Sequence
  Synthetic sequence
ccgtccatgaagggttcgat

SEQ ID NO: 11 - DNA, 20 bp, Artificial Sequence
  Synthetic sequence
acgaatctgccgttgccata

SEQ ID NO: 12 - DNA, 20 bp, Artificial Sequence
  Synthetic sequence
  Misc_feature (1)..(1): There is a phosphate group at the 5' end
ccgtccatgaagggttcgat

SEQ ID NO: 13 - DNA, 20 bp, Artificial Sequence
  Synthetic sequence
  Misc_feature (1)..(1): There is a phosphate group at the 5' end
acgaatctgccgttgccata

SEQ ID NO: 14 - DNA, 60 bp, Artificial Sequence; identical to SEQ ID NO: 9
  Synthetic sequence
  misc_feature (21)..(40): n is a, c, g, or t

SEQ ID NO: 15 - DNA, 27 bp, Artificial Sequence
  Synthetic sequence
ctgtctcttatacacatctgcggccgc

SEQ ID NO: 16 - DNA, 27 bp, Artificial Sequence
  Synthetic sequence
ctgtctcttatacacatctgcggccgc

SEQ ID NO: 17 - DNA, 20 bp, Artificial Sequence
  Synthetic Sequence
ccgtccatgaagggttcgat

SEQ ID NO: 18 - DNA, 20 bp, Artificial Sequence
  Synthetic Sequence
acgaatctgccgttgccata

SEQ ID NO: 19 - DNA, 60 bp, Artificial Sequence; identical to SEQ ID NO: 9
  Synthetic Sequence
  Misc_feature (21)..(40): n is a, c, g, or t

SEQ ID NO: 20 - DNA, 20 bp, Artificial Sequence
  Synthetic Sequence
gagacagggcaagaaacagc

SEQ ID NO: 21 - DNA, 20 bp, Artificial Sequence
  Synthetic Sequence
aacaggcggccttaactgta

SEQ ID NO: 22 - DNA, 22 bp, Artificial Sequence
  Synthetic Sequence
tcctgctcaacttcctgtcgag

SEQ ID NO: 23 - DNA, 22 bp, Artificial Sequence
  Synthetic Sequence
caggtcaaacctcctaggaatg

SEQ ID NO: 24 - DNA, 1844 bp, Artificial Sequence
  Synthetic Sequence
gcggccgcaggcgattaagttgggtaacgccagggttttcccagtcacggcgcgccttgtaaaacgacggccagtgaattcgagctcggtacccggaggcctccacctgggtcttggaatgtgtcccccgaggggtgatgactacctcagttggatctccacaggtcacagtgacacaagataaccaagacacctcccaaggctaccacaatgggccgccctccacgtgcacatggccggaggaactgccatgtcggaggtgcaagcacacctgcgcatcagagtccttggtgtggagggagggaccagcgcagcttccagccatccacctgatgaacagaacctagggaaagccccagttctacttacaccaggaaaggctggaagggctaatttggtcccaaaaaagacaagagatccttgatctgtggatctaccacacacaaggctacttccctgattggcagaactacacaccagggccagggatcagatatccactgacctttggatggtgcttcaagttagtaccagttgaaccagagcaagtagaagaggccaatgaaggagagaacaacagcttgttacaccctatgagccagcatgggatggaggacccggagggagaagtattagtgtggaagtttgacagcctcctagcatttcgtcacatggcccgagagctgcatccggagtactacaaagactgctgacatcgagctttctacaagggactttccgctggggactttccagggaggtgtggcctgggcgggactggggagtggcgagccctcagatgctacatataagcagctgctttttgcctgtactgggtctctctggttagaccagatctgagcctgggagctctctggctaactagggaacccactgcttaagcctcaataaagcttgccttgagtgctcaaagtagtgtgtgcccgtctgttgtgtgactctggtaactagagatccctcagacccttttagtcagtgtggaaaatctctagcagtggcgcccgaacagggacttgaaagcgaaagtaaagccagaggagatctctcgacgcaggactcggcttgctgaagcgcgcacggcaagaggcgaggggcggcgactggtgagtacgccaaaaattttgactagcggaggctagaaggagagagatgggtgcgagagcgtcggtattaagcgggggagaattagataaatgggaaaaaattcggttaaggccagggggaaagaaacaatataaactaaaacatatagtatgggcaagcagggagctagaacgattcgcagttaatcctggccttttagagacatcagaaggctgtagacaaatactgggacagctacaaccatcccttcagacaggatcagaagaacttagatcattatataatacaatagcagtcctctattgtgtgcatcaaaggatagatgtaaaagacaccaaggaagccttagataagatagaggaagagcaaaacaaaagtaagaaaaaggcacagcaagcagcagctgacacaggaaacaacagccaggtcagccaaaattaccctatagtgcagaacctccaggggcaaatggtacatcaggccatatcacctagaactttaaatgcatgggtaaaagtagtagaagagaaggctttcagcccagaagtaatacccatgttttcagcattatcagaaggagccaccccacaagatttaaataccatgctaaacacagtggggggacatcaagcagccatgcaaatgttaaaagagaccatcaatgaggaagctgcagaatgggatagattgcatccagtgcatgcagggcctgcggccgc

SEQ ID NO: 25 - DNA, 1904 bp, Artificial Sequence
  Synthetic Sequence
gcggccgctgcagaatgggatagattgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaataaagataggggggcaattaaaggaagctctattagatacaggagcagatgatacagtattagaagaaatgaatttgccaggaagatggaaaccaaaaatgatagggggaattggaggttttatcaaagtaagacagtatgatcagatactcatagaaatctgcggacataaagctataggtacagtattagtaggacctacacctgtcaacataattggaagaaatctgttgactcagattggctgcactttaaattttcccattagtcctattgagactgtaccagtaaaattaaagccaggaatggatggcccaaaagttaaacaatggccattgacagaagaaaaaataaaagcattagtagaaatttgtacagaaatggaaaaggaaggaaaaatttcaaaaattgggcctgaaaatccatacaatactccagtatttgccataaagaaaaaagacagtactaaatggagaaaattagtagatttcagagaacttaataagagaactcaagatttctgggaagttcaattaggaataccacatcctgcagggttaaaacagaaaaaatcagtaacagtactggatgtgggcgatgcatatttttcagttcccttagataaagacttcaggaagtatactgcatttaccatacctagtataaacaatgagacaccagggattagatatcagtacaatgtgcttccacagggatggaaaggatcaccagcaatattccagtgtagcatgacaaaaatcttagagccttttagaaaacaaaatccagacatagtcatctatcaatacatggatgatttgtatgtaggatctgacttagaaatagggcagcatagaacaaaaatagaggaactgagacaacatctgttgaggtggggatttaccacaccagacaaaaaacatcagaaagaacctccattcctttggatgggttatgaactccatcctgataaatggacagtacagcctatagtgctgccagaaaaggacagctgcggccgc

SEQ ID NO: 26 - DNA, 935 bp, Artificial Sequence
  Synthetic Sequence
tgcagaatgggatagattgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattcaacgaatctgccgttgccatatgatccggccatgggttcaaatcgaacccttcatggacggtgtagaaatttgtacagaaatggaaaaggaaggaaaaatttcaaaaattgggcctgaaaatccatacaatactccagtatttgccataaagaaaaaagacagtactaaatggagaaaattagtagatttcagagaacttaataagagaactcaagatttctgggaagttcaattaggaataccacatcctgcagggttaaaacagaaaaaatcagtaacagtactggatgtgggcgatgcatatttttcagttcccttagataaagacttcaggaagtatactgcatttaccatacctagtataaacaatgagacaccagggattagatatcagtacaatgtgcttccacagggatggaaaggatcaccagcaatattccagtgtagcatgacaaaaatcttagagccttttagaaaacaaaatccagacatagtcatctatcaatacatggatgatttgtatgtaggatctgacttagaaatagggcagcatagaacaaaaatagaggaactgagacaacatctgttgaggtggggatttaccacaccagacaaaaaacatcagaaagaacctccattcctttggatgggttatgaactccatcctgataaatggacagtacagcctatagtgctgccagaaaaggacagct

SEQ ID NO: 27 - DNA, 590 bp, Artificial Sequence
  Synthetic Sequence
tgcagaatgggatagattgcatccagtgcatgcagggcctaccgtccatgaagggttcgattggacccgcccggacgctcatatggcaacggcagattcgttagttcaattaggaataccacatcctgcagggttaaaacagaaaaaatcagtaacagtactggatgtgggcgatgcatatttttcagttcccttagataaagacttcaggaagtatactgcatttaccatacctagtataaacaatgagacaccagggattagatatcagtacaatgtgcttccacagggatggaaaggatcaccagcaatattccagtgtagcatgacaaaaatcttagagccttttagaaaacaaaatccagacatagtcatctatcaatacatggatgatttgtatgtaggatctgacttagaaatagggcagcatagaacaaaaatagaggaactgagacaacatctgttgaggtggggatttaccacaccagacaaaaaacatcagaaagaacctccattcctttggatgggttatgaactccatcctgataaatggacagtacagcctatagtgctgccagaaaaggacagct

SEQ ID NO: 28 - DNA, 404 bp, Artificial Sequence
  Synthetic Sequence
tgcagaatgggatagattgcatccagtgcatgcaccgtccatgaagggttcgatcaggcagctcaagaaacacgtatggcaacggcagattcgttttccacagggatggaaaggatcaccagcaatattccagtgtagcatgacaaaaatcttagagccttttagaaaacaaaatccagacatagtcatctatcaatacatggatgatttgtatgtaggatctgacttagaaatagggcagcatagaacaaaaatagaggaactgagacaacatctgttgaggtggggatttaccacaccagacaaaaaacatcagaaagaacctccattcctttggatgggttatgaactccatcctgataaatggacagtacagcctatagtgctgccagaaaaggacagct

SEQ ID NO: 29 - DNA, 1043 bp, Artificial Sequence
  Synthetic Sequence
tgcagaatgggatagattgcatccagtgcatgcagggcctattgcaccaggccaaacgaatctgccgttgccatatgcagacattacactgtcgaatcgaacccttcatggacggtggaaaccaaaaatgatagggggaattggaggttttatcaaagtaagacagtatgatcagatactcatagaaatctgcggacataaagctataggtacagtattagtaggacctacacctgtcaacataattggaagaaatctgttgactcagattggctgcactttaaattttcccattagtcctattgagactgtaccagtaaaattaaagccaggaatggatggcccaaaagttaaacaatggccattgacagaagaaaaaataaaagcattagtagaaatttgtacagaaatggaaaaggaaggaaaaatttcaaaaattgggcctgaaaatccatacaatactccagtatttgccataaagaaaaaagacagtactaaatggagaaaattagtagatttcagagaacttaataagagaactcaagatttctgggaagttcaattaggaataccacatcctgcagggttaaaacagaaaaaatcagtaacagtactggatgtgggcgatgcatatttttcagttcccttagataaagacttcaggaagtatactgcatttaccatacctagtataaacaatgagacaccagggattagatatcagtacaatgtgcttccacagggatggaaaggatcaccagcaatattccagtgtagcatgacaaaaatcttagagccttttagaaaacaaaatccagacatagtcatctatcaatacatggatgatttgtatgtaggatctgacttagaaatagggcagcatagaacaaaaatagaggaactgagacaacatctgttgaggtggggatttaccacaccagacaaaaaacatcagaaagaacctccattcctttggatgggttatgaactccatcctgataaatggacagtacagcctatagtgctgccagaaaaggacagct

SEQ ID NO: 30 - DNA, 1126 bp, Artificial Sequence
  Synthetic Sequence
tgcagaatgggatagattgcatccagtgcatgcagggcctattgcaccaggccagatgagagaaccaagaccgtccatgaagggttcgatggggggcggcgattacttgttatggcaacggcagattcgttaaaggaagctctattagatacaggagcagatgatacagtattagaagaaatgaatttgccaggaagatggaaaccaaaaatgatagggggaattggaggttttatcaaagtaagacagtatgatcagatactcatagaaatctgcggacataaagctataggtacagtattagtaggacctacacctgtcaacataattggaagaaatctgttgactcagattggctgcactttaaattttcccattagtcctattgagactgtaccagtaaaattaaagccaggaatggatggcccaaaagttaaacaatggccattgacagaagaaaaaataaaagcattagtagaaatttgtacagaaatggaaaaggaaggaaaaatttcaaaaattgggcctgaaaatccatacaatactccagtatttgccataaagaaaaaagacagtactaaatggagaaaattagtagatttcagagaacttaataagagaactcaagatttctgggaagttcaattaggaataccacatcctgcagggttaaaacagaaaaaatcagtaacagtactggatgtgggcgatgcatatttttcagttcccttagataaagacttcaggaagtatactgcatttaccatacctagtataaacaatgagacaccagggattagatatcagtacaatgtgcttccacagggatggaaaggatcaccagcaatattccagtgtagcatgacaaaaatcttagagccttttagaaaacaaaatccagacatagtcatctatcaatacatggatgatttgtatgtaggatctgacttagaaatagggcagcatagaacaaaaatagaggaactgagacaacatctgttgaggtggggatttaccacaccagacaaaaaacatcagaaagaacctccattcctttggatgggttatgaactccatcctgataaatggacagtacagcctatagtgctgccagaaaaggacagct

SEQ ID NO: 31 - DNA, 1091 bp, Artificial Sequence
  Synthetic Sequence
tgcagaatgggatagattgcatccagtgcatgcagggcctattgcaccaggccaaccgtccatgaagggttcgatgagctgcagggcatgttatatatggcaacggcagattcgttcaggagcagatgatacagtattagaagaaatgaatttgccaggaagatggaaaccaaaaatgatagggggaattggaggttttatcaaagtaagacagtatgatcagatactcatagaaatctgcggacataaagctataggtacagtattagtaggacctacacctgtcaacataattggaagaaatctgttgactcagattggctgcactttaaattttcccattagtcctattgagactgtaccagtaaaattaaagccaggaatggatggcccaaaagttaaacaatggccattgacagaagaaaaaataaaagcattagtagaaatttgtacagaaatggaaaaggaaggaaaaatttcaaaaattgggcctgaaaatccatacaatactccagtatttgccataaagaaaaaagacagtactaaatggagaaaattagtagatttcagagaacttaataagagaactcaagatttctgggaagttcaattaggaataccacatcctgcagggttaaaacagaaaaaatcagtaacagtactggatgtgggcgatgcatatttttcagttcccttagataaagacttcaggaagtatactgcatttaccatacctagtataaacaatgagacaccagggattagatatcagtacaatgtgcttccacagggatggaaaggatcaccagcaatattccagtgtagcatgacaaaaatcttagagccttttagaaaacaaaatccagacatagtcatctatcaatacatggatgatttgtatgtaggatctgacttagaaatagggcagcatagaacaaaaatagaggaactgagacaacatctgttgaggtggggatttaccacaccagacaaaaaacatcagaaagaacctccattcctttggatgggttatgaactccatcctgataaatggacagtacagcctatagtgctgccagaaaaggacagct

SEQ ID NO: 32 - DNA, 1155 bp, Artificial Sequence
  Synthetic Sequence
tgcagaatgggatagattgcatccagtgcatgcagggcctattgcaccaggccagatgagagaaccaaggggaagtgacatagcaggaactactagtacccttcaggaacaaataggatggatgacacataatccacctatcccaaccgtccatgaagggttcgatggcgaccctcggccgtggactatggcaacggcagattcgttaaatgaatttgccaggaagatggaaaccaaaaatgatagggggaattggaggttttatcaaagtaagacagtatgatcagatactcatagaaatctgcggacataaagctataggtacagtattagtaggacctacacctgtcaacataattggaagaaatctgttgactcagattggctgcactttaaattttcccattagtcctattgagactgtaccagtaaaattaaagccaggaatggatggcccaaaagttaaacaatggccattgacagaagaaaaaataaaagcattagtagaaatttgtacagaaatggaaaaggaaggaaaaatttcaaaaattgggcctgaaaatccatacaatactccagtatttgccataaagaaaaaagacagtactaaatggagaaaattagtagatttcagagaacttaataagagaactcaagatttctgggaagttcaattaggaataccacatcctgcagggttaaaacagaaaaaatcagtaacagtactggatgtgggcgatgcatatttttcagttcccttagataaagacttcaggaagtatactgcatttaccatacctagtataaacaatgagacaccagggattagatatcagtacaatgtgcttccacagggatggaaaggatcaccagcaatattccagtgtagcatgacaaaaatcttagagccttttagaaaacaaaatccagacatagtcatctatcaatacatggatgatttgtatgtaggatctgacttagaaatagggcagcatagaacaaaaatagaggaactgagacaacatctgttgaggtggggatttaccacaccagacaaaaaacatcagaaagaacctccattcctttggatgggttatgaactccatcctgataaatggacagtacagcctatagtgctgccagaaaaggacagct

SEQ ID NO: 33 - DNA, 1789 bp, Artificial Sequence
  Synthetic Sequence
gcggccgctggacagtacagcctatagtgctgccagaaaaggacagctggactgtcaatgacatacagaaattagtgggaaaattgaattgggcaagtcagatttatgcagggattaaagtaaggcaattatgtaaacttcttaggggaaccaaagcactaacagaagtagtaccactaacagaagaagcagagctagaactggcagaaaacagggagattctaaaagaaccggtacatggagtgtattatgacccatcaaaagacttaatagcagaaatacagaagcaggggcaaggccaatggacatatcaaatttatcaagagccatttaaaaatctgaaaacaggaaagtatgcaagaatgaagggtgcccacactaatgatgtgaaacaattaacagaggcagtacaaaaaatagccacagaaagcatagtaatatggggaaagactcctaaatttaaattacccatacaaaaggaaacatgggaagcatggtggacagagtattggcaagccacctggattcctgagtgggagtttgtcaatacccctcccttagtgaagttatggtaccagttagagaaagaacccataataggagcagaaactttctatgtagatggggcagccaatagggaaactaaattaggaaaagcaggatatgtaactgacagaggaagacaaaaagttgtccccctaacggacacaacaaatcagaagactgagttacaagcaattcatctagctttgcaggattcgggattagaagtaaacatagtgacagactcacaatatgcattgggaatcattcaagcacaaccagataagagtgaatcagagttagtcagtcaaataatagagcagttaataaaaaaggaaaaagtctacctggcatgggtaccagcacacaaaggaattggaggaaatgaacaagtagataaattggtcagtgctggaatcaggaaagtactatttttagatggaatagataaggcccaagaagaacatgagaaatatcacagtaattggagagcaatggctagtgattttaacctaccacctgtagtagcaaaagaaatagtagccagctgtgataaatgtcagctaaaaggggaagccatgcatggacaagtagactgtagcccaggaatatggcagctagattgtacacatttagaaggaaaagttatcttggtagcagttcatgtagccagtggatatatagaagcagaagtaattccagcagagacagggcaagaaacagcatacttcctcttaaaattagcaggaagatggccagtaaaaacagtacatacagacaatggcagcaatttcaccagtactacagttaaggccgcctgttggtgggcggggatcaagcaggaatttggcattccctacaatccccaaagtcaaggagtaatagaatctatgaataaagaattaaagaaaattataggacaggtaagagatcaggctgaacatcttaagacagcagtacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggaaaggaccagcaaagctcctctggaaaggtgaaggggcagtagtaatacaagatggcgcgccagtgtaaagcctggggtgcctaatgagtgagctaactcacgcggccgc

SEQ ID NO: 34 - DNA, 849 bp, Artificial Sequence
  Synthetic Sequence
tggacagtacagcctatagtgctgccagaaaaggacagctggactgtcaatgacatacagaaattagtgggaaaattgaattgggcaagtcagatttatgcagggattaaagtaaggcaattatgtaaacttcttaggggaaccaaagcactaacagaagtagtaccactaacagaagaagcagagctagaactggcagaaaacagggagattctaaaagaaccggtacatggagtgtattatgacccatcaaaagacttaatagcagaaatacagaagcaggggcaaggccaatggacatatcaaatttatcaagagccatttaaaaatctgaaaacaggaaagtatgcaagaatgaacgaatctgccgttgccatatacagcatctgaacaagctgatcgaacccttcatggacggttaaggccgcctgttggtgggcggggatcaagcaggaatttggcattccctacaatccccaaagtcaaggagtaatagaatctatgaataaagaattaaagaaaattataggacaggtaagagatcaggctgaacatcttaagacagcagtacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggaaaggaccagcaaagctcctctggaaaggtgaaggggcagtagtaatacaagatggcgcgccagtgtaaagcctggggtgcctaatgagtgagctaactcac

SEQ ID NO: 35 - DNA, 1633 bp, Artificial Sequence
  Synthetic Sequence
aggcgattaagttgggtaacgccagggttttcccagtcacggcgcgccgctcctctggaaaggtgaaggggcagtagtaatacaagataatagtgacataaaagtagtgccaagaagaaaagcaaagatcatcagggattatggaaaacagatggcaggtgatgattgtgtggcaagtagacaggatgaggattaacacatggaaaagattagtaaaacaccatatgtatatttcaaggaaagctaaggactggttttatagacatcactatgaaagtactaatccaaaaataagttcagaagtacacatcccactaggggatgctaaattagtaataacaacatattggggtctgcatacaggagaaagagactggcatttgggtcagggagtctccatagaatggaggaaaaagagatatagcacacaagtagaccctgacctagcagaccaactaattcatctgcactattttgattgtttttcagaatctgctataagaaataccatattaggacgtatagttagtcctaggtgtgaatatcaagcaggacataacaaggtaggatctctacagtacttggcactagcagcattaataaaaccaaaacagataaagccacctttgcctagtgttaggaaactgacagaggacagatggaacaagccccagaagaccaagggccacagagggagccatacaatgaatggacactagagcttttagaggaacttaagagtgaagctgttagacattttcctaggatatggctccataacttaggacaacatatctatgaaacttacggggatacttgggcaggagtggaagccataataagaattctgcaacaactgctgtttatccatttcagaattgggtgtcgacatagcagaataggcgttactcgacagaggagagcaagaaatggagccagtagatcctagactagagccctggaagcatccaggaagtcagcctaaaactgcttgtaccaattgctattgtaaaaagtgttgctttcattgccaagtttgtttcatgacaaaagccttaggcatctcctatggcaggaagaagcggagacagcgacgaagagctcatcagaacagtcagactcatcaagcttctctatcaaagcagtaagtagtacatgtaatgcaacctataatagtagcaatagtagcattagtagtagcaataataatagcaatagttgtgtggtccatagtaatcatagaatataggaaaatattaagacaaagaaaaatagacaggttaattgatagactaatagaaagagcagaagacagtggcaatgagagtgaaggagaagtatcagcacttgtggagatgggggtggaaatggggcaccatgctccttgggatattgatgatctgtagtgctacagaaaaattgtgggtcacagtctattatggggtacctgtgtggaaggaagcaaccaccactctattttgtgcatcagatgctaaagcatatgatacagaggtacataatgtttgggccacacatgcctgtgtacccacagaccccaacccacaagaagtagtattggtaaatgggcgcgccagtgtaaagcctggggtgcctaatgagtgagctaactcac

SEQ ID NO: 36 - DNA, 614 bp, Artificial Sequence
  Synthetic Sequence
gctcctctggaaaggtgaaggggcagtagtaatacaagataatagtgacataaaagtagtgccaagaagaaaagcaaagatcatcagggattatggaaaacagatggcaggtgatgattgtgtggcccgtccatgaagggttcgattcttgaacagcgcggtctgttatggcaacggcagattcgtttaatgcaacctataatagtagcaatagtagcattagtagtagcaataataatagcaatagttgtgtggtccatagtaatcatagaatataggaaaatattaagacaaagaaaaatagacaggttaattgatagactaatagaaagagcagaagacagtggcaatgagagtgaaggagaagtatcagcacttgtggagatgggggtggaaatggggcaccatgctccttgggatattgatgatctgtagtgctacagaaaaattgtgggtcacagtctattatggggtacctgtgtggaaggaagcaaccaccactctattttgtgcatcagatgctaaagcatatgatacagaggtacataatgtttgggccacacatgcctgtgtacccacagaccccaacccacaagaagtagtattggtaaatg

SEQ ID NO: 37 - DNA, 649 bp, Artificial Sequence
  Synthetic Sequence
aggcgattaagttgggtaacgccagggttttcccagtcacggcgcgccgctcctctggaaaggtgaaggggcagtagtaatacaagataatagtgacataaaagtagtgccaagaagaaaagcaaagatcatcagggattatggaaaacagatggcaggtgatgattgtgtggctaatgcaacctataatagtagcaatagtagcattagtagtagcaataataatagcaatagttgtgtggtccatagtaatcatagaatataggaaaatattaagacaaagaaaaatagacaggttaattgatagactaatagaaagagcagaagacagtggcaatgagagtgaaggagaagtatcagcacttgtggagatgggggtggaaatggggcaccatgctccttgggatattgatgatctgtagtgctacagaaaaattgtgggtcacagtctattatggggtacctgtgtggaaggaagcaaccaccactctattttgtgcatcagatgctaaagcatatgatacagaggtacataatgtttgggccacacatgcctgtgtacccacagaccccaacccacaagaagtagtattggtaaatgggcgcgccagtgtaaagcctggggtgcctaatgagtgagctaactcac

SEQ ID NO: 38 - DNA, 607 bp, Artificial Sequence
  Synthetic Sequence
aggcgattaagttgggtaacgccagggttttcccagtcacggcgcgccgctcctctggaaaggtgaaggggcagtagtaatacaagataatagtgacataaaagtagtgccaagaagaaaagcaaagatcatcagggattatggaaaacagatggcaggtgatgattgtgtaccgtccatgaagggttcgatgatcggtcgtcgcagcggtctatggcaacggcagattcgttagacaaagaaaaatagacaggttaattgatagactaatagaaagagcagaagacagtggcaatgagagtgaaggagaagtatcagcacttgtggagatgggggtggaaatggggcaccatgctccttgggatattgatgatctgtagtgctacagaaaaattgtgggtcacagtctattatggggtacctgtgtggaaggaagcaaccaccactctattttgtgcatcagatgctaaagcatatgatacagaggtacataatgtttgggccacacatgcctgtgtacccacagaccccaacccacaagaagtagtattggtaaatgggcgcgccagtgtaaagcctggggtgcctaatgagtgagctaactcac

SEQ ID NO: 39 - DNA, 389 bp, Artificial Sequence
  Synthetic Sequence
gctcctctggaaaggtgaaggggcagtagtaatacaagataatagtgacataaaagtagtgccaagaagaaaagcaaagatcatcagggattaaccgtccatgaagggttcgattatctgtagccaacattcgatatggcaacggcagattcgttggagatgggggtggaaatggggcaccatgctccttgggatattgatgatctgtagtgctacagaaaaattgtgggtcacagtctattatggggtacctgtgtggaaggaagcaaccaccactctattttgtgcatcagatgctaaagcatatgatacagaggtacataatgtttgggccacacatgcctgtgtacccacagaccccaacccacaagaagtagtattggtaaatg

SEQ ID NO: 40 - DNA, 2125 bp, Artificial Sequence
  Synthetic Sequence
gcggccgcaggcgattaagttgggtaacgccagggttttcccagtcacggcgcgcccccacagaccccaacccacaagaagtagtattggtaaatgtgacagaaaattttaacatgtggaaaaatgacatggtagaacagatgcatgaggatataatcagtttatgggatcaaagcctaaagccatgtgtaaaattaaccccactctgtgttagtttaaagtgcactgatttgaagaatgatactaataccaatagtagtagcgggagaatgataatggagaaaggagagataaaaaactgctctttcaatatcagcacaagcataagagataaggtgcagaaagaatatgcattcttttataaacttgatatagtaccaatagataataccagctataggttgataagttgtaacacctcagtcattacacaggcctgtccaaaggtatcctttgagccaattcccatacattattgtgccccggctggttttgcgattctaaaatgtaataataagacgttcaatggaacaggaccatgtacaaatgtcagcacagtacaatgtacacatggaatcaggccagtagtatcaactcaactgctgttaaatggcagtctagcagaagaagatgtagtaattagatctgccaatttcacagacaatgctaaaaccataatagtacagctgaacacatctgtagaaattaattgtacaagacccaacaacaatacaagaaaaagtatccgtatccagaggggaccagggagagcatttgttacaataggaaaaataggaaatatgagacaagcacattgtaacattagtagagcaaaatggaatgccactttaaaacagatagctagcaaattaagagaacaatttggaaataataaaacaataatctttaagcaatcctcaggaggggacccagaaattgtaacgcacagttttaattgtggaggggaatttttctactgtaattcaacacaactgtttaatagtacttggtttaatagtacttggagtactgaagggtcaaataacactgaaggaagtgacacaatcacactcccatgcagaataaaacaatttataaacatgtggcaggaagtaggaaaagcaatgtatgcccctcccatcagtggacaaattagatgttcatcaaatattactgggctgctattaacaagagatggtggtaataacaacaatgggtccgagatcttcagacctggaggaggcgatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctgatatagtgcagcagcagaacaatttgctgagggctattgaggcgcaacagcatctgttgcaactcacagtctggggcatcaaacagctccaggcaagaatcctggctgtggaaagatacctaaaggatcaacagctcctggggatttggggttgctctggaaaactcatttgcaccactgctgtgccttggaatgctagttggagtaataaatctctggaacagatttggaataacatgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaatcccgaggggacccgacaggcccgaaggaatagaagaagaaggtggagagagagacagagacagatccattcgattagtgaacggatccttagcacttatctgggacgatctgcggagcctgtgcgcggccgc

SEQ ID NO: 41 - DNA, 931 bp, Artificial Sequence
  Synthetic Sequence
gcggccgcatccttagcacttatctgggacgatctgcggagcctgtgcctcttcagctaccaccgcttgagagacttactcttgattgtaacgaggattgtggaacttctgggacgcagggggtgggaagccctcaaatattggtggaatctcctacagtattggagtcaggaactaaagaatagtgctgttaacttgctcaatgccacagccatagcagtagctgaggggacagatagggttatagaagtattacaagcagcttatagagctattcgccacatacctagaagaataagacagggcttggaaaggattttgctataagatgggtggcaagtggtcaaaaagtagtgtgattggatggcctgctgtaagggaaagaatgagacgagctgagccagcagcagatggggtgggagcagtatctcgagacctagaaaaacatggagcaatcacaagtagcaatacagcagctaacaatgctgcttgtgcctggctagaagcacaagaggaggaagaggtgggttttccagtcacacctcaggtacctttaagaccaatgacttacaaggcagctgtagatcttagccactttttaaaagaaaaggggggactggaagggctaattcactcccaaagaagacaagatatccttgatctgtggatctaccacacacaaggctacttccctgattggcagaactacacaccagggccaggggtcagatatccactgacctttggatggtgctacaagctagtaccagttgagccagataaggtagaagaggccaataaaggagagaacaccagcttgttacaccctgtgagcctgcatggaatggatgaccctgagagagaagtgttagagtggaggtttgacagccgcctagcatttcatcacgtggcccgagagctgcgcggccgc

SEQ ID NO: 42 - DNA, 820 bp, Artificial Sequence
  Synthetic Sequence
gcggccgcatccttagcacttatctgggacgatctgcggagcctgtgcctcttcagctaccaccgcttgagagacttactcttgattgtaacgaggattgtggaacttctgggacgcagggggtgggaagccctcaaatattggtggaatctcctacagtattggagtcaggaactaaagaatagtgctgttaacttgctcaatgccacagccatagcagtagctgaggggacagatagggttatagaagtattacaagcagcttatagagctattcgccacatacctagaagaataagacagggcttggaaaggattttgctataagatgggtggcaagtggtcaaaaagtagtgtgattggatggcctgctgtaagggaaagaatgagacgagctgagccagcagcagatggggtgggagcagtatctcgagacctagaaaaacatggagcaatcacaagtagcaatacagcagctaacaatgctgcttgtgcctggctagaagcacaagaggaggaagaggtgggttttccagtcacacctcaggtacctttaagaccaatgacttacaaggcagctgtagatcttagccactttttaaaagaaaaggggggactggaagggctaattcactcccaaagaagacaagatatccttaccgtccatgaagggttcgatcgtaaagtgggatagttttttatggcaacggcagattcgttgagcctgcatggaatggatgaccctgagagagaagtgttagagtggaggtttgacagccgcctagcatttcatcacgtggcccgagagctgcgcggccgc

SEQ ID NO: 43 - DNA, 509 bp, Artificial Sequence
  Synthetic Sequence
gcggccgcgacagccgcctagcatttcatcacgtggcccgagagctgcatccggagtacttcaagaactgctgacatcgagcttgctacaagggactttccgctggggactttccagggaggcgtggcctgggcgggactggggagtggcgagccctcagatgctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcacccaggaggtagaggttgcagtgagccaagatcgcgctctagagtcgacctgcaggcatgcaagcttggcgtaatcaggcgcgccagtgtaaagcctggggtgcctaatgagtgagctaactcacgcggccgc

SEQ ID NO: 44 - DNA, 20 bp, Artificial Sequence
  Synthetic Sequence
ttgaacccatggccggatca

SEQ ID NO: 45 - DNA, 20 bp, Artificial Sequence
  Synthetic Sequence
tggacccgcccggacgctca

SEQ ID NO: 46 - DNA, 20 bp, Artificial Sequence
  Synthetic Sequence
caggcagctcaagaaacacg

SEQ ID NO: 47 - DNA, 20 bp, Artificial Sequence
  Synthetic Sequence
tcgacagtgtaatgtctgca

SEQ ID NO: 48 - DNA, 20 bp, Artificial Sequence
  Synthetic Sequence
ggggggcggcgattacttgt

SEQ ID NO: 49 - DNA, 20 bp, Artificial Sequence
  Synthetic Sequence
gagctgcagggcatgttata

SEQ ID NO: 50 - DNA, 20 bp, Artificial Sequence
  Synthetic Sequence
ggcgaccctcggccgtggac

SEQ ID NO: 51 - DNA, 20 bp, Artificial Sequence
  Synthetic Sequence
cagcttgttcagatgctgta

SEQ ID NO: 52 - DNA, 20 bp, Artificial Sequence
  Synthetic Sequence
tcttgaacagcgcggtctgt

SEQ ID NO: 53 - DNA, 20 bp, Artificial Sequence
  Synthetic Sequence
gatcggtcgtcgcagcggtc

SEQ ID NO: 54 - DNA, 20 bp, Artificial Sequence
  Synthetic Sequence
tatctgtagccaacattcga

SEQ ID NO: 55 - DNA, 20 bp, Artificial Sequence
  Synthetic Sequence
cgtaaagtgggatagttttt

SEQ ID NO: 56 - DNA, 9709 bp, Artificial Sequence
  Synthetic Sequence
tggaagggctaatttggtcccaaaaaagacaagagatccttgatctgtggatctaccacacacaaggctacttccctgattggcagaactacacaccagggccagggatcagatatccactgacctttggatggtgcttcaagttagtaccagttgaaccagagcaagtagaagaggccaatgaaggagagaacaacagcttgttacaccctatgagccagcatgggatggaggacccggagggagaagtattagtgtggaagtttgacagcctcctagcatttcgtcacatggcccgagagctgcatccggagtactacaaagactgctgacatcgagctttctacaagggactttccgctggggactttccagggaggtgtggcctgggcgggactggggagtggcgagccctcagatgctacatataagcagctgctttttgcctgtactgggtctctctggttagaccagatctgagcctgggagctctctggctaactagggaacccactgcttaagcctcaataaagcttgccttgagtgctcaaagtagtgtgtgcccgtctgttgtgtgactctggtaactagagatccctcagacccttttagtcagtgtggaaaatctctagcagtggcgcccgaacagggacttgaaagcgaaagtaaagccagaggagatctctcgacgcaggactcggcttgctgaagcgcgcacggcaagaggcgaggggcggcgactggtgagtacgccaaaaattttgactagcggaggctagaaggagagagatgggtgcgagagcgtcggtattaagcgggggagaattagataaatgggaaaaaattcggttaaggccagggggaaagaaacaatataaactaaaacatatagtatgggcaagcagggagctagaacgattcgcagttaatcctggccttttagagacatcagaaggctgtagacaaatactgggacagctacaaccatcccttcagacaggatcagaagaacttagatcattatataatacaatagcagtcctctattgtgtgcatcaaaggatagatgtaaaagacaccaaggaagccttagataagatagaggaagagcaaaacaaaagtaagaaaaaggcacagcaagcagcagctgacacaggaaacaacagccaggtcagccaaaattaccctatagtgcagaacctccaggggcaaatggtacatcaggccatatcacctagaactttaaatgcatgggtaaaagtagtagaagagaaggctttcagcccagaagtaatacccatgttttcagcattatcagaaggagccaccccacaagatttaaataccatgctaaacacagtggggggacatcaagcagccatgcaaatgttaaaagagaccatcaatgaggaagctgcagaatgggatagattgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaataaagataggggggcaattaaaggaagctctattagatacaggagcagatgatacagtattagaagaaatgaatttgccaggaagatggaaaccaaaaatgatagggggaattggaggttttatcaaagtaagacagtatgatcagatactcatagaaatctgcggacataaagctataggtacagtattagtaggacctacacctgtcaacataattggaagaaatctgttgactcagattggctgcactttaaattttcccattagtcctattgagactgtaccagtaaaattaaagccaggaatggatggcccaaaagttaaacaatggccattgacagaagaaaaaataaaagcattagtagaaatttgtacagaaatggaaaaggaaggaaaaatttcaaaaattgggcctgaaaatccatacaatactccagtatttgccataaagaaaaaagacagtactaaatggagaaaattagtagatttcagagaacttaataagagaactcaagatttctgggaagttcaattaggaataccacatcctgcagggttaaaacagaaaaaatcagtaacagtactggatgtgggcgatgcatatttttcagttcccttagataaagacttcaggaagtatactgcatttaccatacctagtataaacaatgagacaccagggattagatatcagtacaatgtgcttccacagggatggaaaggatcaccagcaatattccagtgtagcatgacaaaaatcttagagccttttagaaaacaaaatccagacatagtcatctatcaatacatggatgatttgtatgtaggatctgacttagaaatagggcagcatagaacaaaaatagaggaactgagacaacatctgttgaggtggggatttaccacaccagacaaaaaacatcagaaagaacctccattcctttggatgggttatgaactccatcctgataaatggacagtacagcctatagtgctgccagaaaaggacagctggactgtcaatgacatacagaaattagtgggaaaattgaattgggcaagtcagatttatgcagggattaaagtaaggcaattatgtaaacttcttaggggaaccaaagcactaacagaagtagtaccactaacagaagaagcagagctagaactggcagaaaacagggagattctaaaagaaccggtacatggagtgtattatgacccatcaaaagacttaatagcagaaatacagaagcaggggcaaggccaatggacatatcaaatttatcaagagccatttaaaaatctgaaaacaggaaagtatgcaagaatgaagggtgcccacactaatgatgtgaaacaattaacagaggcagtacaaaaaatagccacagaaagcatagtaatatggggaaagactcctaaatttaaattacccatacaaaaggaaacatgggaagcatggtggacagagtattggcaagccacctggattcctgagtgggagtttgtcaatacccctcccttagtgaagttatggtaccagttagagaaagaacccataataggagcagaaactttctatgtagatggggcagccaatagggaaactaaattaggaaaagcaggatatgtaactgacagaggaagacaaaaagttgtccccctaacggacacaacaaatcagaagactgagttacaagcaattcatctagctttgcaggattcgggattagaagtaaacatagtgacagactcacaatatgcattgggaatcattcaagcacaaccagataagagtgaatcagagttagtcagtcaaataatagagcagttaataaaaaaggaaaaagtctacctggcatgggtaccagcacacaaaggaattggaggaaatgaacaagtagataaattggtcagtgctggaatcaggaaagtactatttttagatggaatagataaggcccaagaagaacatgagaaatatcacagtaattggagagcaatggctagtgattttaacctaccacctgtagtagcaaaagaaatagtagccagctgtgataaatgtcagctaaaaggggaagccatgcatggacaagtagactgtagcccaggaatatggcagctagattgtacacatttagaaggaaaagttatcttggtagcagttcatgtagccagtggatatatagaagcagaagtaattccagcagagacagggcaagaaacagcatacttcctcttaaaattagcaggaagatggccagtaaaaacagtacatacagacaatggcagcaatttcaccagtactacagttaaggccgcctgttggtgggcggggatcaagcaggaatttggcattccctacaatccccaaagtcaaggagtaatagaatctatgaataaagaattaaagaaaattataggacaggtaagagatcaggctgaacatcttaagacagcagtacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggaaaggaccagcaaagctcctctggaaaggtgaaggggcagtagtaatacaagataatagtgacataaaagtagtgccaagaagaaaagcaaagatcatcagggattatggaaaacagatggcaggtgatgattgtgtggcaagtagacaggatgaggattaacacatggaaaagattagtaaaacaccatatgtatatttcaaggaaagctaaggactggttttatagacatcactatgaaagtactaatccaaaaataagttcagaagtacacatcccactaggggatgctaaattagtaataacaacatattggggtctgcatacaggagaaagagactggcatttgggtcagggagtctccatagaatggaggaaaaagagatatagcacacaagtagaccctgacctagcagaccaactaattcatctgcactattttgattgtttttcagaatctgctataagaaataccatattaggacgtatagttagtcctaggtgtgaatatcaagcaggacataacaaggtaggatctctacagtacttggcactagcagcattaataaaaccaaaacagataaagccacctttgcctagtgttaggaaactgacagaggacagatggaacaagccccagaagaccaagggccacagagggagccatacaatgaatggacactagagcttttagaggaacttaagagtgaagctgttagacattttcctaggatatggctccataacttaggacaacatatctatgaaacttacggggatacttgggcaggagtggaagccataataagaattctgcaacaactgctgtttatccatttcagaattgggtgtcgacatagcagaataggcgttactcgacagaggagagcaagaaatggagccagtagatcctagactagagccctggaagcatccaggaagtcagcctaaaactgcttgtaccaattgctattgtaaaaagtgttgctttcattgccaagtttgtttcatgacaaaagccttaggcatctcctatggcaggaagaagcggagacagcgacgaagagctcatcagaacagtcagactcatcaagcttctctatcaaagcagtaagtagtacatgtaatgcaacctataatagtagcaatagtagcattagtagtagcaataataatagcaatagttgtgtggtccatagtaatcatagaatataggaaaatattaagacaaagaaaaatagacaggttaattgatagactaatagaaagagcagaagacagtggcaatgagagtgaaggagaagtatcagcacttgtggagatgggggtggaaatggggcaccatgctccttgggatattgatgatctgtagtgctacagaaaaattgtgggtcacagtctattatggggtacctgtgtggaaggaagcaaccaccactctattttgtgcatcagatgctaaagcatatgatacagaggtacataatgtttgggccacacatgcctgtgtacccacagaccccaacccacaagaagtagtattggtaaatgtgacagaaaattttaacatgtggaaaaatgacatggtagaacagatgcatgaggatataatcagtttatgggatcaaagcctaaagccatgtgtaaaattaaccccactctgtgttagtttaaagtgcactgatttgaagaatgatactaataccaatagtagtagcgggagaatgataatggagaaaggagagataaaaaactgctctttcaatatcagcacaagcataagagataaggtgcagaaagaatatgcattcttttataaacttgatatagtaccaatagataataccagctataggttgataagttgtaacacctcagtcattacacaggcctgtccaaaggtatcctttgagccaattcccatacattattgtgccccggctggttttgcgattctaaaatgtaataataagacgttcaatggaacaggaccatgtacaaatgtcagcacagtacaatgtacacatggaatcaggccagtagtatcaactcaactgctgttaaatggcagtctagcagaagaagatgtagtaattagatctgccaatttcacagacaatgctaaaaccataatagtacagctgaacacatctgtagaaattaattgtacaagacccaacaacaatacaagaaaaagtatccgtatccagaggggaccagggagagcatttgttacaataggaaaaataggaaatatgagacaagcacattgtaacattagtagagcaaaatggaatgccactttaaaacagatagctagcaaattaagagaacaatttggaaataataaaacaataatctttaagcaatcctcaggaggggacccagaaattgtaacgcacagttttaattgtggaggggaatttttctactgtaattcaacacaactgtttaatagtacttggtttaatagtacttggagtactgaagggtcaaataacactgaaggaagtgacacaatcacactcccatgcagaataaaacaatttataaacatgtggcaggaagtaggaaaagcaatgtatgcccctcccatcagtggacaaattagatgttcatcaaatattactgggctgctattaacaagagatggtggtaataacaacaatgggtccgagatcttcagacctggaggaggcgatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctgatatagtgcagcagcagaacaatttgctgagggctattgaggcgcaacagcatctgttgcaactcacagtctggggcatcaaacagctccaggcaagaatcctggctgtggaaagatacctaaaggatcaacagctcctggggatttggggttgctctggaaaactcatttgcaccactgctgtgccttggaatgctagttggagtaataaatctctggaacagatttggaataacatgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaatcccgaggggacccgacaggcccgaaggaatagaagaagaaggtggagagagagacagagacagatccattcgattagtgaacggatccttagcacttatctgggacgatctgcggagcctgtgcctcttcagctaccaccgcttgagagacttactcttgattgtaacgaggattgtggaacttctgggacgcagggggtgggaagccctcaaatattggtggaatctcctacagtattggagtcaggaactaaagaatagtgctgttaacttgctcaatgccacagccatagcagtagctgaggggacagatagggttatagaagtattacaagcagcttatagagctattcgccacatacctagaagaataagacagggcttggaaaggattttgctataagatgggtggcaagtggtcaaaaagtagtgtgattggatggcctgctgtaagggaaagaatgagacgagctgagccagcagcagatggggtgggagcagtatctcgagacctagaaaaacatggagcaatcacaagtagcaatacagcagctaacaatgctgcttgtgcctggctagaagcacaagaggaggaagaggtgggttttccagtcacacctcaggtacctttaagaccaatgacttacaaggcagctgtagatcttagccactttttaaaagaaaaggggggactggaagggctaattcactcccaaagaagacaagatatccttgatctgtggatctaccacacacaaggctacttccctgattggcagaactacacaccagggccaggggtcagatatccactgacctttggatggtgctacaagctagtaccagttgagccagataaggtagaagaggccaataaaggagagaacaccagcttgttacaccctgtgagcctgcatggaatggatgaccctgagagagaagtgttagagtggaggtttgacagccgcctagcatttcatcacgtggcccgagagctgcatccggagtacttcaagaactgctgacatcgagcttgctacaagggactttccgctggggactttccagggaggcgtggcctgggcgggactggggagtggcgagccctcagatgctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagca

SEQ ID NO: 57 - DNA, 9598 bp, Artificial Sequence
  Synthetic Sequence
tggaagggctaatttggtcccaaaaaagacaagagatccttgatctgtggatctaccacacacaaggctacttccctgattggcagaactacacaccagggccagggatcagatatccactgacctttggatggtgcttcaagttagtaccagttgaaccagagcaagtagaagaggccaatgaaggagagaacaacagcttgttacaccctatgagccagcatgggatggaggacccggagggagaagtattagtgtggaagtttgacagcctcctagcatttcgtcacatggcccgagagctgcatccggagtactacaaagactgctgacatcgagctttctacaagggactttccgctggggactttccagggaggtgtggcctgggcgggactggggagtggcgagccctcagatgctacatataagcagctgctttttgcctgtactgggtctctctggttagaccagatctgagcctgggagctctctggctaactagggaacccactgcttaagcctcaataaagcttgccttgagtgctcaaagtagtgtgtgcccgtctgttgtgtgactctggtaactagagatccctcagacccttttagtcagtgtggaaaatctctagcagtggcgcccgaacagggacttgaaagcgaaagtaaagccagaggagatctctcgacgcaggactcggcttgctgaagcgcgcacggcaagaggcgaggggcggcgactggtgagtacgccaaaaattttgactagcggaggctagaaggagagagatgggtgcgagagcgtcggtattaagcgggggagaattagataaatgggaaaaaattcggttaaggccagggggaaagaaacaatataaactaaaacatatagtatgggcaagcagggagctagaacgattcgcagttaatcctggccttttagagacatcagaaggctgtagacaaatactgggacagctacaaccatcccttcagacaggatcagaagaacttagatcattatataatacaatagcagtcctctattgtgtgcatcaaaggatagatgtaaaagacaccaaggaagccttagataagatagaggaagagcaaaacaaaagtaagaaaaaggcacagcaagcagcagctgacacaggaaacaacagccaggtcagccaaaattaccctatagtgcagaacctccaggggcaaatggtacatcaggccatatcacctagaactttaaatgcatgggtaaaagtagtagaagagaaggctttcagcccagaagtaatacccatgttttcagcattatcagaaggagccaccccacaagatttaaataccatgctaaacacagtggggggacatcaagcagccatgcaaatgttaaaagagaccatcaatgaggaagctgcagaatgggatagattgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaataaagataggggggcaattaaaggaagctctattagatacaggagcagatgatacagtattagaagaaatgaatttgccaggaagatggaaaccaaaaatgatagggggaattggaggttttatcaaagtaagacagtatgatcagatactcatagaaatctgcggacataaagctataggtacagtattagtaggacctacacctgtcaacataattggaagaaatctgttgactcagattggctgcactttaaattttcccattagtcctattgagactgtaccagtaaaattaaagccaggaatggatggcccaaaagttaaacaatggccattgacagaagaaaaaataaaagcattagtagaaatttgtacagaaatggaaaaggaaggaaaaatttcaaaaattgggcctgaaaatccatacaatactccagtatttgccataaagaaaaaagacagtactaaatggagaaaattagtagatttcagagaacttaataagagaactcaagatttctgggaagttcaattaggaataccacatcctgcagggttaaaacagaaaaaatcagtaacagtactggatgtgggcgatgcatatttttcagttcccttagataaagacttcaggaagtatactgcatttaccatacctagtataaacaatgagacaccagggattagatatcagtacaatgtgcttccacagggatggaaaggatcaccagcaatattccagtgtagcatgacaaaaatcttagagccttttagaaaacaaaatccagacatagtcatctatcaatacatggatgatttgtatgtaggatctgacttagaaatagggcagcatagaacaaaaatagaggaactgagacaacatctgttgaggtggggatttaccacaccagacaaaaaacatcagaaagaacctccattcctttggatgggttatgaactccatcctgataaatggacagtacagcctatagtgctgccagaaaaggacagctggactgtcaatgacatacagaaattagtgggaaaattgaattgggcaagtcagatttatgcagggattaaagtaaggcaattatgtaaacttcttaggggaaccaaagcactaacagaagtagtaccactaacagaagaagcagagctagaactggcagaaaacagggagattctaaaagaaccggtacatggagtgtattatgacccatcaaaagacttaatagcagaaatacagaagcaggggcaaggccaatggacatatcaaatttatcaagagccatttaaaaatctgaaaacaggaaagtatgcaagaatgaagggtgcccacactaatgatgtgaaacaattaacagaggcagtacaaaaaatagccacagaaagcatagtaatatggggaaagactcctaaatttaaattacccatacaaaaggaaacatgggaagcatggtggacagagtattggcaagccacctggattcctgagtgggagtttgtcaatacccctcccttagtgaagttatggtaccagttagagaaagaacccataataggagcagaaactttctatgtagatggggcagccaatagggaaactaaattaggaaaagcaggatatgtaactgacagaggaagacaaaaagttgtccccctaacggacacaacaaatcagaagactgagttacaagcaattcatctagctttgcaggattcgggattagaagtaaacatagtgacagactcacaatatgcattgggaatcattcaagcacaaccagataagagtgaatcagagttagtcagtcaaataatagagcagttaataaaaaaggaaaaagtctacctggcatgggtaccagcacacaaaggaattggaggaaatgaacaagtagataaattggtcagtgctggaatcaggaaagtactatttttagatggaatagataaggcccaagaagaacatgagaaatatcacagtaattggagagcaatggctagtgattttaacctaccacctgtagtagcaaaagaaatagtagccagctgtgataaatgtcagctaaaaggggaagccatgcatggacaagtagactgtagcccaggaatatggcagctagattgtacacatttagaaggaaaagttatcttggtagcagttcatgtagccagtggatatatagaagcagaagtaattccagcagagacagggcaagaaacagcatacttcctcttaaaattagcaggaagatggccagtaaaaacagtacatacagacaatggcagcaatttcaccagtactacagttaaggccgcctgttggtgggcggggatcaagcaggaatttggcattccctacaatccccaaagtcaaggagtaatagaatctatgaataaagaattaaagaaaattataggacaggtaagagatcaggctgaacatcttaagacagcagtacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggaaaggaccagcaaagctcctctggaaaggtgaaggggcagtagtaatacaagataatagtgacataaaagtagtgccaagaagaaaagcaaagatcatcagggattatggaaaacagatggcaggtgatgattgtgtggcaagtagacaggatgaggattaacacatggaaaagattagtaaaacaccatatgtatatttcaaggaaagctaaggactggttttatagacatcactatgaaagtactaatccaaaaataagttcagaagtacacatcccactaggggatgctaaattagtaataacaacatattggggtctgcatacaggagaaagagactggcatttgggtcagggagtctccatagaatggaggaaaaagagatatagcacacaagtagaccctgacctagcagaccaactaattcatctgcactattttgattgtttttcagaatctgctataagaaataccatattaggacgtatagttagtcctaggtgtgaatatcaagcaggacataacaaggtaggatctctacagtacttggcactagcagcattaataaaaccaaaacagataaagccacctttgcctagtgttaggaaactgacagaggacagatggaacaagccccagaagaccaagggccacagagggagccatacaatgaatggacactagagcttttagaggaacttaagagtgaagctgttagacattttcctaggatatggctccataacttaggacaacatatctatgaaacttacggggatacttgggcaggagtggaagccataataagaattctgcaacaactgctgtttatccatttcagaattgggtgtcgacatagcagaataggcgttactcgacagaggagagcaagaaatggagccagtagatcctagactagagccctggaagcatccaggaagtcagcctaaaactgcttgtaccaattgctattgtaaaaagtgttgctttcattgccaagtttgtttcatgacaaaagccttaggcatctcctatggcaggaagaagcggagacagcgacgaagagctcatcagaacagtcagactcatcaagcttctctatcaaagcagtaagtagtacatgtaatgcaacctataatagtagcaatagtagcattagtagtagcaataataatagcaatagttgtgtggtccatagtaatcatagaatataggaaaatattaagacaaagaaaaatagacaggttaattgatagactaatagaaagagcagaagacagtggcaatgagagtgaaggagaagtatcagcacttgtggagatgggggtggaaatggggcaccatgctccttgggatattgatgatctgtagtgctacagaaaaattgtgggtcacagtctattatggggtacctgtgtggaaggaagcaaccaccactctattttgtgcatcagatgctaaagcatatgatacagaggtacataatgtttgggccacacatgcctgtgtacccacagaccccaacccacaagaagtagtattggtaaatgtgacagaaaattttaacatgtggaaaaatgacatggtagaacagatgcatgaggatataatcagtttatgggatcaaagcctaaagccatgtgtaaaattaaccccactctgtgttagtttaaagtgcactgatttgaagaatgatactaataccaatagtagtagcgggagaatgataatggagaaaggagagataaaaaactgctctttcaatatcagcacaagcataagagataaggtgcagaaagaatatgcattcttttataaacttgatatagtaccaatagataataccagctataggttgataagttgtaacacctcagtcattacacaggcctgtccaaaggtatcctttgagccaattcccatacattattgtgccccggctggttttgcgattctaaaatgtaataataagacgttcaatggaacaggaccatgtacaaatgtcagcacagtacaatgtacacatggaatcaggccagtagtatcaactcaactgctgttaaatggcagtctagcagaagaagatgtagtaattagatctgccaatttcacagacaatgctaaaaccataatagtacagctgaacacatctgtagaaattaattgtacaagacccaacaacaatacaagaaaaagtatccgtatccagaggggaccagggagagcatttgttacaataggaaaaataggaaatatgagacaagcacattgtaacattagtagagcaaaatggaatgccactttaaaacagatagctagcaaattaagagaacaatttggaaataataaaacaataatctttaagcaatcctcaggaggggacccagaaattgtaacgcacagttttaattgtggaggggaatttttctactgtaattcaacacaactgtttaatagtacttggtttaatagtacttggagtactgaagggtcaaataacactgaaggaagtgacacaatcacactcccatgcagaataaaacaatttataaacatgtggcaggaagtaggaaaagcaatgtatgcccctcccatcagtggacaaattagatgttcatcaaatattactgggctgctattaacaagagatggtggtaataacaacaatgggtccgagatcttcagacctggaggaggcgatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctgatatagtgcagcagcagaacaatttgctgagggctattgaggcgcaacagcatctgttgcaactcacagtctggggcatcaaacagctccaggcaagaatcctggctgtggaaagatacctaaaggatcaacagctcctggggatttggggttgctctggaaaactcatttgcaccactgctgtgccttggaatgctagttggagtaataaatctctggaacagatttggaataacatgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaatcccgaggggacccgacaggcccgaaggaatagaagaagaaggtggagagagagacagagacagatccattcgattagtgaacggatccttagcacttatctgggacgatctgcggagcctgtgcctcttcagctaccaccgcttgagagacttactcttgattgtaacgaggattgtggaacttctgggacgcagggggtgggaagccctcaaatattggtggaatctcctacagtattggagtcaggaactaaagaatagtgctgttaacttgctcaatgccacagccatagcagtagctgaggggacagatagggttatagaagtattacaagcagcttatagagctattcgccacatacctagaagaataagacagggcttggaaaggattttgctataagatgggtggcaagtggtcaaaaagtagtgtgattggatggcctgctgtaagggaaagaatgagacgagctgagccagcagcagatggggtgggagcagtatctcgagacctagaaaaacatggagcaatcacaagtagcaatacagcagctaacaatgctgcttgtgcctggctagaagcacaagaggaggaagaggtgggttttccagtcacacctcaggtacctttaagaccaatgacttacaaggcagctgtagatcttagccactttttaaaagaaaaggggggactggaagggctaattcactcccaaagaagacaagatatccttaccgtccatgaagggttcgatcgtaaagtgggatagttttttatggcaacggcagattcgttgagcctgcatggaatggatgaccctgagagagaagtgttagagtggaggtttgacagccgcctagcatttcatcacgtggcccgagagctgcatccggagtacttcaagaactgctgacatcgagcttgctacaagggactttccgctggggactttccagggaggcgtggcctgggcgggactggggagtggcgagccctcagatgctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagca

SEQ ID NO: 58 - DNA, 8786 bp, Artificial Sequence
  Synthetic Sequence
tggaagggctaatttggtcccaaaaaagacaagagatccttgatctgtggatctaccacacacaaggctacttccctgattggcagaactacacaccagggccagggatcagatatccactgacctttggatggtgcttcaagttagtaccagttgaaccagagcaagtagaagaggccaatgaaggagagaacaacagcttgttacaccctatgagccagcatgggatggaggacccggagggagaagtattagtgtggaagtttgacagcctcctagcatttcgtcacatggcccgagagctgcatccggagtactacaaagactgctgacatcgagctttctacaagggactttccgctggggactttccagggaggtgtggcctgggcgggactggggagtggcgagccctcagatgctacatataagcagctgctttttgcctgtactgggtctctctggttagaccagatctgagcctgggagctctctggctaactagggaacccactgcttaagcctcaataaagcttgccttgagtgctcaaagtagtgtgtgcccgtctgttgtgtgactctggtaactagagatccctcagacccttttagtcagtgtggaaaatctctagcagtggcgcccgaacagggacttgaaagcgaaagtaaagccagaggagatctctcgacgcaggactcggcttgctgaagcgcgcacggcaagaggcgaggggcggcgactggtgagtacgccaaaaattttgactagcggaggctagaaggagagagatgggtgcgagagcgtcggtattaagcgggggagaattagataaatgggaaaaaattcggttaaggccagggggaaagaaacaatataaactaaaacatatagtatgggcaagcagggagctagaacgattcgcagttaatcctggccttttagagacatcagaaggctgtagacaaatactgggacagctacaaccatcccttcagacaggatcagaagaacttagatcattatataatacaatagcagtcctctattgtgtgcatcaaaggatagatgtaaaagacaccaaggaagccttagataagatagaggaagagcaaaacaaaagtaagaaaaaggcacagcaagcagcagctgacacaggaaacaacagccaggtcagccaaaattaccctatagtgcagaacctccaggggcaaatggtacatcaggccatatcacctagaactttaaatgcatgggtaaaagtagtagaagagaaggctttcagcccagaagtaatacccatgttttcagcattatcagaaggagccaccccacaagatttaaataccatgctaaacacagtggggggacatcaagcagccatgcaaatgttaaaagagaccatcaatgaggaagctgcagaatgggatagattgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaataaagataggggggcaattaaaggaagctctattagatacaggagcagatgatacagtattagaagaaatgaatttgccaggaagatggaaaccaaaaatgatagggggaattggaggttttatcaaagtaagacagtatgatcagatactcatagaaatctgcggacataaagctataggtacagtattagtaggacctacacctgtcaacataattggaagaaatctgttgactcagattggctgcactttaaattttcccattagtcctattgagactgtaccagtaaaattaaagccaggaatggatggcccaaaagttaaacaatggccattgacagaagaaaaaataaaagcattagtagaaatttgtacagaaatggaaaaggaaggaaaaatttcaaaaattgggcctgaaaatccatacaatactccagtatttgccataaagaaaaaagacagtactaaatggagaaaattagtagatttcagagaacttaataagagaactcaagatttctgggaagttcaattaggaataccacatcctgcagggttaaaacagaaaaaatcagtaacagtactggatgtgggcgatgcatatttttcagttcccttagataaagacttcaggaagtatactgcatttaccatacctagtataaacaatgagacaccagggattagatatcagtacaatgtgcttccacagggatggaaaggatcaccagcaatattccagtgtagcatgacaaaaatcttagagccttttagaaaacaaaatccagacatagtcatctatcaatacatggatgatttgtatgtaggatctgacttagaaatagggcagcatagaacaaaaatagaggaactgagacaacatctgttgaggtggggatttaccacaccagacaaaaaacatcagaaagaacctccattcctttggatgggttatgaactccatcctgataaatggacagtacagcctatagtgctgccagaaaaggacagctggactgtcaatgacatacagaaattagtgggaaaattgaattgggcaagtcagatttatgcagggattaaagtaaggcaattatgtaaacttcttaggggaaccaaagcactaacagaagtagtaccactaacagaagaagcagagctagaactggcagaaaacagggagattctaaaagaaccggtacatggagtgtattatgacccatcaaaagacttaatagcagaaatacagaagcaggggcaaggccaatggacatatcaaatttatcaagagccatttaaaaatctgaaaacaggaaagtatgcaagaatgaagggtgcccacactaatgatgtgaaacaattaacagaggcagtacaaaaaatagccacagaaagcatagtaatatggggaaagactcctaaatttaaattacccatacaaaaggaaacatgggaagcatggtggacagagtattggcaagccacctggattcctgagtgggagtttgtcaatacccctcccttagtgaagttatggtaccagttagagaaagaacccataataggagcagaaactttctatgtagatggggcagccaatagggaaactaaattaggaaaagcaggatatgtaactgacagaggaagacaaaaagttgtccccctaacggacacaacaaatcagaagactgagttacaagcaattcatctagctttgcaggattcgggattagaagtaaacatagtgacagactcacaatatgcattgggaatcattcaagcacaaccagataagagtgaatcagagttagtcagtcaaataatagagcagttaataaaaaaggaaaaagtctacctggcatgggtaccagcacacaaaggaattggaggaaatgaacaagtagataaattggtcagtgctggaatcaggaaagtactatttttagatggaatagataaggcccaagaagaacatgagaaatatcacagtaattggagagcaatggctagtgattttaacctaccacctgtagtagcaaaagaaatagtagccagctgtgataaatgtcagctaaaaggggaagccatgcatggacaagtagactgtagcccaggaatatggcagctagattgtacacatttagaaggaaaagttatcttggtagcagttcatgtagccagtggatatatagaagcagaagtaattccagcagagacagggcaagaaacagcatacttcctcttaaaattagcaggaagatggccagtaaaaacagtacatacagacaatggcagcaatttcaccagtactacagttaaggccgcctgttggtgggcggggatcaagcaggaatttggcattccctacaatccccaaagtcaaggagtaatagaatctatgaataaagaattaaagaaaattataggacaggtaagagatcaggctgaacatcttaagacagcagtacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggaaaggaccagcaaagctcctctggaaaggtgaaggggcagtagtaatacaagataatagtgacataaaagtagtgccaagaagaaaagcaaagatcatcagggattatggaaaacagatggcaggtgatgattgtgtggcccgtccatgaagggttcgattcttgaacagcgcggtctgttatggcaacggcagattcgtttaatgcaacctataatagtagcaatagtagcattagtagtagcaataataatagcaatagttgtgtggtccatagtaatcatagaatataggaaaatattaagacaaagaaaaatagacaggttaattgatagactaatagaaagagcagaagacagtggcaatgagagtgaaggagaagtatcagcacttgtggagatgggggtggaaatggggcaccatgctccttgggatattgatgatctgtagtgctacagaaaaattgtgggtcacagtctattatggggtacctgtgtggaaggaagcaaccaccactctattttgtgcatcagatgctaaagcatatgatacagaggtacataatgtttgggccacacatgcctgtgtacccacagaccccaacccacaagaagtagtattggtaaatgtgacagaaaattttaacatgtggaaaaatgacatggtagaacagatgcatgaggatataatcagtttatgggatcaaagcctaaagccatgtgtaaaattaaccccactctgtgttagtttaaagtgcactgatttgaagaatgatactaataccaatagtagtagcgggagaatgataatggagaaaggagagataaaaaactgctctttcaatatcagcacaagcataagagataaggtgcagaaagaatatgcattcttttataaacttgatatagtaccaatagataataccagctataggttgataagttgtaacacctcagtcattacacaggcctgtccaaaggtatcctttgagccaattcccatacattattgtgccccggctggttttgcgattctaaaatgtaataataagacgttcaatggaacaggaccatgtacaaatgtcagcacagtacaatgtacacatggaatcaggccagtagtatcaactcaactgctgttaaatggcagtctagcagaagaagatgtagtaattagatctgccaatttcacagacaatgctaaaaccataatagtacagctgaacacatctgtagaaattaattgtacaagacccaacaacaatacaagaaaaagtatccgtatccagaggggaccagggagagcatttgttacaataggaaaaataggaaatatgagacaagcacattgtaacattagtagagcaaaatggaatgccactttaaaacagatagctagcaaattaagagaacaatttggaaataataaaacaataatctttaagcaatcctcaggaggggacccagaaattgtaacgcacagttttaattgtggaggggaatttttctactgtaattcaacacaactgtttaatagtacttggtttaatagtacttggagtactgaagggtcaaataacactgaaggaagtgacacaatcacactcccatgcagaataaaacaatttataaacatgtggcaggaagtaggaaaagcaatgtatgcccctcccatcagtggacaaattagatgttcatcaaatattactgggctgctattaacaagagatggtggtaataacaacaatgggtccgagatcttcagacctggaggaggcgatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctgatatagtgcagcagcagaacaatttgctgagggctattgaggcgcaacagcatctgttgcaactcacagtctggggcatcaaacagctccaggcaagaatcctggctgtggaaagatacctaaaggatcaacagctcctggggatttggggttgctctggaaaactcatttgcaccactgctgtgccttggaatgctagttggagtaataaatctctggaacagatttggaataacatgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaatcccgaggggacccgacaggcccgaaggaatagaagaagaaggtggagagagagacagagacagatccattcgattagtgaacggatccttagcacttatctgggacgatctgcggagcctgtgcctcttcagctaccaccgcttgagagacttactcttgattgtaacgaggattgtggaacttctgggacgcagggggtgggaagccctcaaatattggtggaatctcctacagtattggagtcaggaactaaagaatagtgctgttaacttgctcaatgccacagccatagcagtagctgaggggacagatagggttatagaagtattacaagcagcttatagagctattcgccacatacctagaagaataagacagggcttggaaaggattttgctataagatgggtggcaagtggtcaaaaagtagtgtgattggatggcctgctgtaagggaaagaatgagacgagctgagccagcagcagatggggtgggagcagtatctcgagacctagaaaaacatggagcaatcacaagtagcaatacagcagctaacaatgctgcttgtgcctggctagaagcacaagaggaggaagaggtgggttttccagtcacacctcaggtacctttaagaccaatgacttacaaggcagctgtagatcttagccactttttaaaagaaaaggggggactggaagggctaattcactcccaaagaagacaagatatccttgatctgtggatctaccacacacaaggctacttccctgattggcagaactacacaccagggccaggggtcagatatccactgacctttggatggtgctacaagctagtaccagttgagccagataaggtagaagaggccaataaaggagagaacaccagcttgttacaccctgtgagcctgcatggaatggatgaccctgagagagaagtgttagagtggaggtttgacagccgcctagcatttcatcacgtggcccgagagctgcatccggagtacttcaagaactgctgacatcgagcttgctacaagggactttccgctggggactttccagggaggcgtggcctgggcgggactggggagtggcgagccctcagatgctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagca

SEQ ID NO: 59 - DNA, 8675 bp, Artificial Sequence
  Synthetic Sequence
tggaagggctaatttggtcccaaaaaagacaagagatccttgatctgtggatctaccacacacaaggctacttccctgattggcagaactacacaccagggccagggatcagatatccactgacctttggatggtgcttcaagttagtaccagttgaaccagagcaagtagaagaggccaatgaaggagagaacaacagcttgttacaccctatgagccagcatgggatggaggacccggagggagaagtattagtgtggaagtttgacagcctcctagcatttcgtcacatggcccgagagctgcatccggagtactacaaagactgctgacatcgagctttctacaagggactttccgctggggactttccagggaggtgtggcctgggcgggactggggagtggcgagccctcagatgctacatataagcagctgctttttgcctgtactgggtctctctggttagaccagatctgagcctgggagctctctggctaactagggaacccactgcttaagcctcaataaagcttgccttgagtgctcaaagtagtgtgtgcccgtctgttgtgtgactctggtaactagagatccctcagacccttttagtcagtgtggaaaatctctagcagtggcgcccgaacagggacttgaaagcgaaagtaaagccagaggagatctctcgacgcaggactcggcttgctgaagcgcgcacggcaagaggcgaggggcggcgactggtgagtacgccaaaaattttgactagcggaggctagaaggagagagatgggtgcgagagcgtcggtattaagcgggggagaattagataaatgggaaaaaattcggttaaggccagggggaaagaaacaatataaactaaaacatatagtatgggcaagcagggagctagaacgattcgcagttaatcctggccttttagagacatcagaaggctgtagacaaatactgggacagctacaaccatcccttcagacaggatcagaagaacttagatcattatataatacaatagcagtcctctattgtgtgcatcaaaggatagatgtaaaagacaccaaggaagccttagataagatagaggaagagcaaaacaaaagtaagaaaaaggcacagcaagcagcagctgacacaggaaacaacagccaggtcagccaaaattaccctatagtgcagaacctccaggggcaaatggtacatcaggccatatcacctagaactttaaatgcatgggtaaaagtagtagaagagaaggctttcagcccagaagtaatacccatgttttcagcattatcagaaggagccaccccacaagatttaaataccatgctaaacacagtggggggacatcaagcagccatgcaaatgttaaaagagaccatcaatgaggaagctgcagaatgggatagattgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaataaagataggggggcaattaaaggaagctctattagatacaggagcagatgatacagtattagaagaaatgaatttgccaggaagatggaaaccaaaaatgatagggggaattggaggttttatcaaagtaagacagtatgatcagatactcatagaaatctgcggacataaagctataggtacagtattagtaggacctacacctgtcaacataattggaagaaatctgttgactcagattggctgcactttaaattttcccattagtcctattgagactgtaccagtaaaattaaagccaggaatggatggcccaaaagttaaacaatggccattgacagaagaaaaaataaaagcattagtagaaatttgtacagaaatggaaaaggaaggaaaaatttcaaaaattgggcctgaaaatccatacaatactccagtatttgccataaagaaaaaagacagtactaaatggagaaaattagtagatttcagagaacttaataagagaactcaagatttctgggaagttcaattaggaataccacatcctgcagggttaaaacagaaaaaatcagtaacagtactggatgtgggcgatgcatatttttcagttcccttagataaagacttcaggaagtatactgcatttaccatacctagtataaacaatgagacaccagggattagatatcagtacaatgtgcttccacagggatggaaaggatcaccagcaatattccagtgtagcatgacaaaaatcttagagccttttagaaaacaaaatccagacatagtcatctatcaatacatggatgatttgtatgtaggatctgacttagaaatagggcagcatagaacaaaaatagaggaactgagacaacatctgttgaggtggggatttaccacaccagacaaaaaacatcagaaagaacctccattcctttggatgggttatgaactccatcctgataaatggacagtacagcctatagtgctgccagaaaaggacagctggactgtcaatgacatacagaaattagtgggaaaattgaattgggcaagtcagatttatgcagggattaaagtaaggcaattatgtaaacttcttaggggaaccaaagcactaacagaagtagtaccactaacagaagaagcagagctagaactggcagaaaacagggagattctaaaagaaccggtacatggagtgtattatgacccatcaaaagacttaatagcagaaatacagaagcaggggcaaggccaatggacatatcaaatttatcaagagccatttaaaaatctgaaaacaggaaagtatgcaagaatgaagggtgcccacactaatgatgtgaaacaattaacagaggcagtacaaaaaatagccacagaaagcatagtaatatggggaaagactcctaaatttaaattacccatacaaaaggaaacatgggaagcatggtggacagagtattggcaagccacctggattcctgagtgggagtttgtcaatacccctcccttagtgaagttatggtaccagttagagaaagaacccataataggagcagaaactttctatgtagatggggcagccaatagggaaactaaattaggaaaagcaggatatgtaactgacagaggaagacaaaaagttgtccccctaacggacacaacaaatcagaagactgagttacaagcaattcatctagctttgcaggattcgggattagaagtaaacatagtgacagactcacaatatgcattgggaatcattcaagcacaaccagataagagtgaatcagagttagtcagtcaaataatagagcagttaataaaaaaggaaaaagtctacctggcatgggtaccagcacacaaaggaattggaggaaatgaacaagtagataaattggtcagtgctggaatcaggaaagtactatttttagatggaatagataaggcccaagaagaacatgagaaatatcacagtaattggagagcaatggctagtgattttaacctaccacctgtagtagcaaaagaaatagtagccagctgtgataaatgtcagctaaaaggggaagccatgcatggacaagtagactgtagcccaggaatatggcagctagattgtacacatttagaaggaaaagttatcttggtagcagttcatgtagccagtggatatatagaagcagaagtaattccagcagagacagggcaagaaacagcatacttcctcttaaaattagcaggaagatggccagtaaaaacagtacatacagacaatggcagcaatttcaccagtactacagttaaggccgcctgttggtgggcggggatcaagcaggaatttggcattccctacaatccccaaagtcaaggagtaatagaatctatgaataaagaattaaagaaaattataggacaggtaagagatcaggctgaacatcttaagacagcagtacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggaaaggaccagcaaagctcctctggaaaggtgaaggggcagtagtaatacaagataatagtgacataaaagtagtgccaagaagaaaagcaaagatcatcagggattatggaaaacagatggcaggtgatgattgtgtggcccgtccatgaagggttcgattcttgaacagcgcggtctgttatggcaacggcagattcgtttaatgcaacctataatagtagcaatagtagcattagtagtagcaataataatagcaatagttgtgtggtccatagtaatcatagaatataggaaaatattaagacaaagaaaaatagacaggttaattgatagactaatagaaagagcagaagacagtggcaatgagagtgaaggagaagtatcagcacttgtggagatgggggtggaaatggggcaccatgctccttgggatattgatgatctgtagtgctacagaaaaattgtgggtcacagtctattatggggtacctgtgtggaaggaagcaaccaccactctattttgtgcatcagatgctaaagcatatgatacagaggtacataatgtttgggccacacatgcctgtgtacccacagaccccaacccacaagaagtagtattggtaaatgtgacagaaaattttaacatgtggaaaaatgacatggtagaacagatgcatgaggatataatcagtttatgggatcaaagcctaaagccatgtgtaaaattaaccccactctgtgttagtttaaagtgcactgatttgaagaatgatactaataccaatagtagtagcgggagaatgataatggagaaaggagagataaaaaactgctctttcaatatcagcacaagcataagagataaggtgcagaaagaatatgcattcttttataaacttgatatagtaccaatagataataccagctataggttgataagttgtaacacctcagtcattacacaggcctgtccaaaggtatcctttgagccaattcccatacattattgtgccccggctggttttgcgattctaaaatgtaataataagacgttcaatggaacaggaccatgtacaaatgtcagcacagtacaatgtacacatggaatcaggccagtagtatcaactcaactgctgttaaatggcagtctagcagaagaagatgtagtaattagatctgccaatttcacagacaatgctaaaaccataatagtacagctgaacacatctgtagaaattaattgtacaagacccaacaacaatacaagaaaaagtatccgtatccagaggggaccagggagagcatttgttacaataggaaaaataggaaatatgagacaagcacattgtaacattagtagagcaaaatggaatgccactttaaaacagatagctagcaaattaagagaacaatttggaaataataaaacaataatctttaagcaatcctcaggaggggacccagaaattgtaacgcacagttttaattgtggaggggaatttttctactgtaattcaacacaactgtttaatagtacttggtttaatagtacttggagtactgaagggtcaaataacactgaaggaagtgacacaatcacactcccatgcagaataaaacaatttataaacatgtggcaggaagtaggaaaagcaatgtatgcccctcccatcagtggacaaattagatgttcatcaaatattactgggctgctattaacaagagatggtggtaataacaacaatgggtccgagatcttcagacctggaggaggcgatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctgatatagtgcagcagcagaacaatttgctgagggctattgaggcgcaacagcatctgttgcaactcacagtctggggcatcaaacagctccaggcaagaatcctggctgtggaaagatacctaaaggatcaacagctcctggggatttggggttgctctggaaaactcatttgcaccactgctgtgccttggaatgctagttggagtaataaatctctggaacagatttggaataacatgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaatcccgaggggacccgacaggcccgaaggaatagaagaagaaggtggagagagagacagagacagatccattcgattagtgaacggatccttagcacttatctgggacgatctgcggagcctgtgcctcttcagctaccaccgcttgagagacttactcttgattgtaacgaggattgtggaacttctgggacgcagggggtgggaagccctcaaatattggtggaatctcctacagtattggagtcaggaactaaagaatagtgctgttaacttgctcaatgccacagccatagcagtagctgaggggacagatagggttatagaagtattacaagcagcttatagagctattcgccacatacctagaagaataagacagggcttggaaaggattttgctataagatgggtggcaagtggtcaaaaagtagtgtgattggatggcctgctgtaagggaaagaatgagacgagctgagccagcagcagatggggtgggagcagtatctcgagacctagaaaaacatggagcaatcacaagtagcaatacagcagctaacaatgctgcttgtgcctggctagaagcacaagaggaggaagaggtgggttttccagtcacacctcaggtacctttaagaccaatgacttacaaggcagctgtagatcttagccactttttaaaagaaaaggggggactggaagggctaattcactcccaaagaagacaagatatccttaccgtccatgaagggttcgatcgtaaagtgggatagttttttatggcaacggcagattcgttgagcctgcatggaatggatgaccctgagagagaagtgttagagtggaggtttgacagccgcctagcatttcatcacgtggcccgagagctgcatccggagtacttcaagaactgctgacatcgagcttgctacaagggactttccgctggggactttccagggaggcgtggcctgggcgggactggggagtggcgagccctcagatgctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagca

SEQ ID NO: 60 - DNA, 8725 bp, Artificial Sequence
  Synthetic Sequence
tggaagggctaatttggtcccaaaaaagacaagagatccttgatctgtggatctaccacacacaaggctacttccctgattggcagaactacacaccagggccagggatcagatatccactgacctttggatggtgcttcaagttagtaccagttgaaccagagcaagtagaagaggccaatgaaggagagaacaacagcttgttacaccctatgagccagcatgggatggaggacccggagggagaagtattagtgtggaagtttgacagcctcctagcatttcgtcacatggcccgagagctgcatccggagtactacaaagactgctgacatcgagctttctacaagggactttccgctggggactttccagggaggtgtggcctgggcgggactggggagtggcgagccctcagatgctacatataagcagctgctttttgcctgtactgggtctctctggttagaccagatctgagcctgggagctctctggctaactagggaacccactgcttaagcctcaataaagcttgccttgagtgctcaaagtagtgtgtgcccgtctgttgtgtgactctggtaactagagatccctcagacccttttagtcagtgtggaaaatctctagcagtggcgcccgaacagggacttgaaagcgaaagtaaagccagaggagatctctcgacgcaggactcggcttgctgaagcgcgcacggcaagaggcgaggggcggcgactggtgagtacgccaaaaattttgactagcggaggctagaaggagagagatgggtgcgagagcgtcggtattaagcgggggagaattagataaatgggaaaaaattcggttaaggccagggggaaagaaacaatataaactaaaacatatagtatgggcaagcagggagctagaacgattcgcagttaatcctggccttttagagacatcagaaggctgtagacaaatactgggacagctacaaccatcccttcagacaggatcagaagaacttagatcattatataatacaatagcagtcctctattgtgtgcatcaaaggatagatgtaaaagacaccaaggaagccttagataagatagaggaagagcaaaacaaaagtaagaaaaaggcacagcaagcagcagctgacacaggaaacaacagccaggtcagccaaaattaccctatagtgcagaacctccaggggcaaatggtacatcaggccatatcacctagaactttaaatgcatgggtaaaagtagtagaagagaaggctttcagcccagaagtaatacccatgttttcagcattatcagaaggagccaccccacaagatttaaataccatgctaaacacagtggggggacatcaagcagccatgcaaatgttaaaagagaccatcaatgaggaagctgcagaatgggatagattgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaataaagataggggggcaattaaaggaagctctattagatacaggagcagatgatacagtattagaagaaatgaatttgccaggaagatggaaaccaaaaatgatagggggaattggaggttttatcaaagtaagacagtatgatcagatactcatagaaatctgcggacataaagctataggtacagtattagtaggacctacacctgtcaacataattggaagaaatctgttgactcagattggctgcactttaaattttcccattagtcctattgagactgtaccagtaaaattaaagccaggaatggatggcccaaaagttaaacaatggccattgacagaagaaaaaataaaagcattagtagaaatttgtacagaaatggaaaaggaaggaaaaatttcaaaaattgggcctgaaaatccatacaatactccagtatttgccataaagaaaaaagacagtactaaatggagaaaattagtagatttcagagaacttaataagagaactcaagatttctgggaagttcaattaggaataccacatcctgcagggttaaaacagaaaaaatcagtaacagtactggatgtgggcgatgcatatttttcagttcccttagataaagacttcaggaagtatactgcatttaccatacctagtataaacaatgagacaccagggattagatatcagtacaatgtgcttccacagggatggaaaggatcaccagcaatattccagtgtagcatgacaaaaatcttagagccttttagaaaacaaaatccagacatagtcatctatcaatacatggatgatttgtatgtaggatctgacttagaaatagggcagcatagaacaaaaatagaggaactgagacaacatctgttgaggtggggatttaccacaccagacaaaaaacatcagaaagaacctccattcctttggatgggttatgaactccatcctgataaatggacagtacagcctatagtgctgccagaaaaggacagctggactgtcaatgacatacagaaattagtgggaaaattgaattgggcaagtcagatttatgcagggattaaagtaaggcaattatgtaaacttcttaggggaaccaaagcactaacagaagtagtaccactaacagaagaagcagagctagaactggcagaaaacagggagattctaaaagaaccggtacatggagtgtattatgacccatcaaaagacttaatagcagaaatacagaagcaggggcaaggccaatggacatatcaaatttatcaagagccatttaaaaatctgaaaacaggaaagtatgcaagaatgaagggtgcccacactaatgatgtgaaacaattaacagaggcagtacaaaaaatagccacagaaagcatagtaatatggggaaagactcctaaatttaaattacccatacaaaaggaaacatgggaagcatggtggacagagtattggcaagccacctggattcctgagtgggagtttgtcaatacccctcccttagtgaagttatggtaccagttagagaaagaacccataataggagcagaaactttctatgtagatggggcagccaatagggaaactaaattaggaaaagcaggatatgtaactgacagaggaagacaaaaagttgtccccctaacggacacaacaaatcagaagactgagttacaagcaattcatctagctttgcaggattcgggattagaagtaaacatagtgacagactcacaatatgcattgggaatcattcaagcacaaccagataagagtgaatcagagttagtcagtcaaataatagagcagttaataaaaaaggaaaaagtctacctggcatgggtaccagcacacaaaggaattggaggaaatgaacaagtagataaattggtcagtgctggaatcaggaaagtactatttttagatggaatagataaggcccaagaagaacatgagaaatatcacagtaattggagagcaatggctagtgattttaacctaccacctgtagtagcaaaagaaatagtagccagctgtgataaatgtcagctaaaaggggaagccatgcatggacaagtagactgtagcccaggaatatggcagctagattgtacacatttagaaggaaaagttatcttggtagcagttcatgtagccagtggatatatagaagcagaagtaattccagcagagacagggcaagaaacagcatacttcctcttaaaattagcaggaagatggccagtaaaaacagtacatacagacaatggcagcaatttcaccagtactacagttaaggccgcctgttggtgggcggggatcaagcaggaatttggcattccctacaatccccaaagtcaaggagtaatagaatctatgaataaagaattaaagaaaattataggacaggtaagagatcaggctgaacatcttaagacagcagtacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggaaaggaccagcaaagctcctctggaaaggtgaaggggcagtagtaatacaagataatagtgacataaaagtagtgccaagaagaaaagcaaagatcatcagggattatggaaaacagatggcaggtgatgattgtgtggctaatgcaacctataatagtagcaatagtagcattagtagtagcaataataatagcaatagttgtgtggtccatagtaatcatagaatataggaaaatattaagacaaagaaaaatagacaggttaattgatagactaatagaaagagcagaagacagtggcaatgagagtgaaggagaagtatcagcacttgtggagatgggggtggaaatggggcaccatgctccttgggatattgatgatctgtagtgctacagaaaaattgtgggtcacagtctattatggggtacctgtgtggaaggaagcaaccaccactctattttgtgcatcagatgctaaagcatatgatacagaggtacataatgtttgggccacacatgcctgtgtacccacagaccccaacccacaagaagtagtattggtaaatgtgacagaaaattttaacatgtggaaaaatgacatggtagaacagatgcatgaggatataatcagtttatgggatcaaagcctaaagccatgtgtaaaattaaccccactctgtgttagtttaaagtgcactgatttgaagaatgatactaataccaatagtagtagcgggagaatgataatggagaaaggagagataaaaaactgctctttcaatatcagcacaagcataagagataaggtgcagaaagaatatgcattcttttataaacttgatatagtaccaatagataataccagctataggttgataagttgtaacacctcagtcattacacaggcctgtccaaaggtatcctttgagccaattcccatacattattgtgccccggctggttttgcgattctaaaatgtaataataagacgttcaatggaacaggaccatgtacaaatgtcagcacagtacaatgtacacatggaatcaggccagtagtatcaactcaactgctgttaaatggcagtctagcagaagaagatgtagtaattagatctgccaatttcacagacaatgctaaaaccataatagtacagctgaacacatctgtagaaattaattgtacaagacccaacaacaatacaagaaaaagtatccgtatccagaggggaccagggagagcatttgttacaataggaaaaataggaaatatgagacaagcacattgtaacattagtagagcaaaatggaatgccactttaaaacagatagctagcaaattaagagaacaatttggaaataataaaacaataatctttaagcaatcctcaggaggggacccagaaattgtaacgcacagttttaattgtggaggggaatttttctactgtaattcaacacaactgtttaatagtacttggtttaatagtacttggagtactgaagggtcaaataacactgaaggaagtgacacaatcacactcccatgcagaataaaacaatttataaacatgtggcaggaagtaggaaaagcaatgtatgcccctcccatcagtggacaaattagatgttcatcaaatattactgggctgctattaacaagagatggtggtaataacaacaatgggtccgagatcttcagacctggaggaggcgatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctgatatagtgcagcagcagaacaatttgctgagggctattgaggcgcaacagcatctgttgcaactcacagtctggggcatcaaacagctccaggcaagaatcctggctgtggaaagatacctaaaggatcaacagctcctggggatttggggttgctctggaaaactcatttgcaccactgctgtgccttggaatgctagttggagtaataaatctctggaacagatttggaataacatgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaatcccgaggggacccgacaggcccgaaggaatagaagaagaaggtggagagagagacagagacagatccattcgattagtgaacggatccttagcacttatctgggacgatctgcggagcctgtgcctcttcagctaccaccgcttgagagacttactcttgattgtaacgaggattgtggaacttctgggacgcagggggtgggaagccctcaaatattggtggaatctcctacagtattggagtcaggaactaaagaatagtgctgttaacttgctcaatgccacagccatagcagtagctgaggggacagatagggttatagaagtattacaagcagcttatagagctattcgccacatacctagaagaataagacagggcttggaaaggattttgctataagatgggtggcaagtggtcaaaaagtagtgtgattggatggcctgctgtaagggaaagaatgagacgagctgagccagcagcagatggggtgggagcagtatctcgagacctagaaaaacatggagcaatcacaagtagcaatacagcagctaacaatgctgcttgtgcctggctagaagcacaagaggaggaagaggtgggttttccagtcacacctcaggtacctttaagaccaatgacttacaaggcagctgtagatcttagccactttttaaaagaaaaggggggactggaagggctaattcactcccaaagaagacaagatatccttgatctgtggatctaccacacacaaggctacttccctgattggcagaactacacaccagggccaggggtcagatatccactgacctttggatggtgctacaagctagtaccagttgagccagataaggtagaagaggccaataaaggagagaacaccagcttgttacaccctgtgagcctgcatggaatggatgaccctgagagagaagtgttagagtggaggtttgacagccgcctagcatttcatcacgtggcccgagagctgcatccggagtacttcaagaactgctgacatcgagcttgctacaagggactttccgctggggactttccagggaggcgtggcctgggcgggactggggagtggcgagccctcagatgctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagca

SEQ ID NO: 61 - DNA, 8614 bp, Artificial Sequence
  Synthetic Sequence
tggaagggctaatttggtcccaaaaaagacaagagatccttgatctgtggatctaccacacacaaggctacttccctgattggcagaactacacaccagggccagggatcagatatccactgacctttggatggtgcttcaagttagtaccagttgaaccagagcaagtagaagaggccaatgaaggagagaacaacagcttgttacaccctatgagccagcatgggatggaggacccggagggagaagtattagtgtggaagtttgacagcctcctagcatttcgtcacatggcccgagagctgcatccggagtactacaaagactgctgacatcgagctttctacaagggactttccgctggggactttccagggaggtgtggcctgggcgggactggggagtggcgagccctcagatgctacatataagcagctgctttttgcctgtactgggtctctctggttagaccagatctgagcctgggagctctctggctaactagggaacccactgcttaagcctcaataaagcttgccttgagtgctcaaagtagtgtgtgcccgtctgttgtgtgactctggtaactagagatccctcagacccttttagtcagtgtggaaaatctctagcagtggcgcccgaacagggacttgaaagcgaaagtaaagccagaggagatctctcgacgcaggactcggcttgctgaagcgcgcacggcaagaggcgaggggcggcgactggtgagtacgccaaaaattttgactagcggaggctagaaggagagagatgggtgcgagagcgtcggtattaagcgggggagaattagataaatgggaaaaaattcggttaaggccagggggaaagaaacaatataaactaaaacatatagtatgggcaagcagggagctagaacgattcgcagttaatcctggccttttagagacatcagaaggctgtagacaaatactgggacagctacaaccatcccttcagacaggatcagaagaacttagatcattatataatacaatagcagtcctctattgtgtgcatcaaaggatagatgtaaaagacaccaaggaagccttagataagatagaggaagagcaaaacaaaagtaagaaaaaggcacagcaagcagcagctgacacaggaaacaacagccaggtcagccaaaattaccctatagtgcagaacctccaggggcaaatggtacatcaggccatatcacctagaactttaaatgcatgggtaaaagtagtagaagagaaggctttcagcccagaagtaatacccatgttttcagcattatcagaaggagccaccccacaagatttaaataccatgctaaacacagtggggggacatcaagcagccatgcaaatgttaaaagagaccatcaatgaggaagctgcagaatgggatagattgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaataaagataggggggcaattaaaggaagctctattagatacaggagcagatgatacagtattagaagaaatgaatttgccaggaagatggaaaccaaaaatgatagggggaattggaggttttatcaaagtaagacagtatgatcagatactcatagaaatctgcggacataaagctataggtacagtattagtaggacctacacctgtcaacataattggaagaaatctgttgactcagattggctgcactttaaattttcccattagtcctattgagactgtaccagtaaaattaaagccaggaatggatggcccaaaagttaaacaatggccattgacagaagaaaaaataaaagcattagtagaaatttgtacagaaatggaaaaggaaggaaaaatttcaaaaattgggcctgaaaatccatacaatactccagtatttgccataaagaaaaaagacagtactaaatggagaaaattagtagatttcagagaacttaataagagaactcaagatttctgggaagttcaattaggaataccacatcctgcagggttaaaacagaaaaaatcagtaacagtactggatgtgggcgatgcatatttttcagttcccttagataaagacttcaggaagtatactgcatttaccatacctagtataaacaatgagacaccagggattagatatcagtacaatgtgcttccacagggatggaaaggatcaccagcaatattccagtgtagcatgacaaaaatcttagagccttttagaaaacaaaatccagacatagtcatctatcaatacatggatgatttgtatgtaggatctgacttagaaatagggcagcatagaacaaaaatagaggaactgagacaacatctgttgaggtggggatttaccacaccagacaaaaaacatcagaaagaacctccattcctttggatgggttatgaactccatcctgataaatggacagtacagcctatagtgctgccagaaaaggacagctggactgtcaatgacatacagaaattagtgggaaaattgaattgggcaagtcagatttatgcagggattaaagtaaggcaattatgtaaacttcttaggggaaccaaagcactaacagaagtagtaccactaacagaagaagcagagctagaactggcagaaaacagggagattctaaaagaaccggtacatggagtgtattatgacccatcaaaagacttaatagcagaaatacagaagcaggggcaaggccaatggacatatcaaatttatcaagagccatttaaaaatctgaaaacaggaaagtatgcaagaatgaagggtgcccacactaatgatgtgaaacaattaacagaggcagtacaaaaaatagccacagaaagcatagtaatatggggaaagactcctaaatttaaattacccatacaaaaggaaacatgggaagcatggtggacagagtattggcaagccacctggattcctgagtgggagtttgtcaatacccctcccttagtgaagttatggtaccagttagagaaagaacccataataggagcagaaactttctatgtagatggggcagccaatagggaaactaaattaggaaaagcaggatatgtaactgacagaggaagacaaaaagttgtccccctaacggacacaacaaatcagaagactgagttacaagcaattcatctagctttgcaggattcgggattagaagtaaacatagtgacagactcacaatatgcattgggaatcattcaagcacaaccagataagagtgaatcagagttagtcagtcaaataatagagcagttaataaaaaaggaaaaagtctacctggcatgggtaccagcacacaaaggaattggaggaaatgaacaagtagataaattggtcagtgctggaatcaggaaagtactatttttagatggaatagataaggcccaagaagaacatgagaaatatcacagtaattggagagcaatggctagtgattttaacctaccacctgtagtagcaaaagaaatagtagccagctgtgataaatgtcagctaaaaggggaagccatgcatggacaagtagactgtagcccaggaatatggcagctagattgtacacatttagaaggaaaagttatcttggtagcagttcatgtagccagtggatatatagaagcagaagtaattccagcagagacagggcaagaaacagcatacttcctcttaaaattagcaggaagatggccagtaaaaacagtacatacagacaatggcagcaatttcaccagtactacagttaaggccgcctgttggtgggcggggatcaagcaggaatttggcattccctacaatccccaaagtcaaggagtaatagaatctatgaataaagaattaaagaaaattataggacaggtaagagatcaggctgaacatcttaagacagcagtacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggaaaggaccagcaaagctcctctggaaaggtgaaggggcagtagtaatacaagataatagtgacataaaagtagtgccaagaagaaaagcaaagatcatcagggattatggaaaacagatggcaggtgatgattgtgtggctaatgcaacctataatagtagcaatagtagcattagtagtagcaataataatagcaatagttgtgtggtccatagtaatcatagaatataggaaaatattaagacaaagaaaaatagacaggttaattgatagactaatagaaagagcagaagacagtggcaatgagagtgaaggagaagtatcagcacttgtggagatgggggtggaaatggggcaccatgctccttgggatattgatgatctgtagtgctacagaaaaattgtgggtcacagtctattatggggtacctgtgtggaaggaagcaaccaccactctattttgtgcatcagatgctaaagcatatgatacagaggtacataatgtttgggccacacatgcctgtgtacccacagaccccaacccacaagaagtagtattggtaaatgtgacagaaaattttaacatgtggaaaaatgacatggtagaacagatgcatgaggatataatcagtttatgggatcaaagcctaaagccatgtgtaaaattaaccccactctgtgttagtttaaagtgcactgatttgaagaatgatactaataccaatagtagtagcgggagaatgataatggagaaaggagagataaaaaactgctctttcaatatcagcacaagcataagagataaggtgcagaaagaatatgcattcttttataaacttgatatagtaccaatagataataccagctataggttgataagttgtaacacctcagtcattacacaggcctgtccaaaggtatcctttgagccaattcccatacattattgtgccccggctggttttgcgattctaaaatgtaataataagacgttcaatggaacaggaccatgtacaaatgtcagcacagtacaatgtacacatggaatcaggccagtagtatcaactcaactgctgttaaatggcagtctagcagaagaagatgtagtaattagatctgccaatttcacagacaatgctaaaaccataatagtacagctgaacacatctgtagaaattaattgtacaagacccaacaacaatacaagaaaaagtatccgtatccagaggggaccagggagagcatttgttacaataggaaaaataggaaatatgagacaagcacattgtaacattagtagagcaaaatggaatgccactttaaaacagatagctagcaaattaagagaacaatttggaaataataaaacaataatctttaagcaatcctcaggaggggacccagaaattgtaacgcacagttttaattgtggaggggaatttttctactgtaattcaacacaactgtttaatagtacttggtttaatagtacttggagtactgaagggtcaaataacactgaaggaagtgacacaatcacactcccatgcagaataaaacaatttataaacatgtggcaggaagtaggaaaagcaatgtatgcccctcccatcagtggacaaattagatgttcatcaaatattactgggctgctattaacaagagatggtggtaataacaacaatgggtccgagatcttcagacctggaggaggcgatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctgatatagtgcagcagcagaacaatttgctgagggctattgaggcgcaacagcatctgttgcaactcacagtctggggcatcaaacagctccaggcaagaatcctggctgtggaaagatacctaaaggatcaacagctcctggggatttggggttgctctggaaaactcatttgcaccactgctgtgccttggaatgctagttggagtaataaatctctggaacagatttggaataacatgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaatcccgaggggacccgacaggcccgaaggaatagaagaagaaggtggagagagagacagagacagatccattcgattagtgaacggatccttagcacttatctgggacgatctgcggagcctgtgcctcttcagctaccaccgcttgagagacttactcttgattgtaacgaggattgtggaacttctgggacgcagggggtgggaagccctcaaatattggtggaatctcctacagtattggagtcaggaactaaagaatagtgctgttaacttgctcaatgccacagccatagcagtagctgaggggacagatagggttatagaagtattacaagcagcttatagagctattcgccacatacctagaagaataagacagggcttggaaaggattttgctataagatgggtggcaagtggtcaaaaagtagtgtgattggatggcctgctgtaagggaaagaatgagacgagctgagccagcagcagatggggtgggagcagtatctcgagacctagaaaaacatggagcaatcacaagtagcaatacagcagctaacaatgctgcttgtgcctggctagaagcacaagaggaggaagaggtgggttttccagtcacacctcaggtacctttaagaccaatgacttacaaggcagctgtagatcttagccactttttaaaagaaaaggggggactggaagggctaattcactcccaaagaagacaagatatccttaccgtccatgaagggttcgatcgtaaagtgggatagttttttatggcaacggcagattcgttgagcctgcatggaatggatgaccctgagagagaagtgttagagtggaggtttgacagccgcctagcatttcatcacgtggcccgagagctgcatccggagtacttcaagaactgctgacatcgagcttgctacaagggactttccgctggggactttccagggaggcgtggcctgggcgggactggggagtggcgagccctcagatgctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagca

SEQ ID NO: 62 - DNA, 8683 bp, Artificial Sequence
  Synthetic Sequence
tggaagggctaatttggtcccaaaaaagacaagagatccttgatctgtggatctaccacacacaaggctacttccctgattggcagaactacacaccagggccagggatcagatatccactgacctttggatggtgcttcaagttagtaccagttgaaccagagcaagtagaagaggccaatgaaggagagaacaacagcttgttacaccctatgagccagcatgggatggaggacccggagggagaagtattagtgtggaagtttgacagcctcctagcatttcgtcacatggcccgagagctgcatccggagtactacaaagactgctgacatcgagctttctacaagggactttccgctggggactttccagggaggtgtggcctgggcgggactggggagtggcgagccctcagatgctacatataagcagctgctttttgcctgtactgggtctctctggttagaccagatctgagcctgggagctctctggctaactagggaacccactgcttaagcctcaataaagcttgccttgagtgctcaaagtagtgtgtgcccgtctgttgtgtgactctggtaactagagatccctcagacccttttagtcagtgtggaaaatctctagcagtggcgcccgaacagggacttgaaagcgaaagtaaagccagaggagatctctcgacgcaggactcggcttgctgaagcgcgcacggcaagaggcgaggggcggcgactggtgagtacgccaaaaattttgactagcggaggctagaaggagagagatgggtgcgagagcgtcggtattaagcgggggagaattagataaatgggaaaaaattcggttaaggccagggggaaagaaacaatataaactaaaacatatagtatgggcaagcagggagctagaacgattcgcagttaatcctggccttttagagacatcagaaggctgtagacaaatactgggacagctacaaccatcccttcagacaggatcagaagaacttagatcattatataatacaatagcagtcctctattgtgtgcatcaaaggatagatgtaaaagacaccaaggaagccttagataagatagaggaagagcaaaacaaaagtaagaaaaaggcacagcaagcagcagctgacacaggaaacaacagccaggtcagccaaaattaccctatagtgcagaacctccaggggcaaatggtacatcaggccatatcacctagaactttaaatgcatgggtaaaagtagtagaagagaaggctttcagcccagaagtaatacccatgttttcagcattatcagaaggagccaccccacaagatttaaataccatgctaaacacagtggggggacatcaagcagccatgcaaatgttaaaagagaccatcaatgaggaagctgcagaatgggatagattgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaataaagataggggggcaattaaaggaagctctattagatacaggagcagatgatacagtattagaagaaatgaatttgccaggaagatggaaaccaaaaatgatagggggaattggaggttttatcaaagtaagacagtatgatcagatactcatagaaatctgcggacataaagctataggtacagtattagtaggacctacacctgtcaacataattggaagaaatctgttgactcagattggctgcactttaaattttcccattagtcctattgagactgtaccagtaaaattaaagccaggaatggatggcccaaaagttaaacaatggccattgacagaagaaaaaataaaagcattagtagaaatttgtacagaaatggaaaaggaaggaaaaatttcaaaaattgggcctgaaaatccatacaatactccagtatttgccataaagaaaaaagacagtactaaatggagaaaattagtagatttcagagaacttaataagagaactcaagatttctgggaagttcaattaggaataccacatcctgcagggttaaaacagaaaaaatcagtaacagtactggatgtgggcgatgcatatttttcagttcccttagataaagacttcaggaagtatactgcatttaccatacctagtataaacaatgagacaccagggattagatatcagtacaatgtgcttccacagggatggaaaggatcaccagcaatattccagtgtagcatgacaaaaatcttagagccttttagaaaacaaaatccagacatagtcatctatcaatacatggatgatttgtatgtaggatctgacttagaaatagggcagcatagaacaaaaatagaggaactgagacaacatctgttgaggtggggatttaccacaccagacaaaaaacatcagaaagaacctccattcctttggatgggttatgaactccatcctgataaatggacagtacagcctatagtgctgccagaaaaggacagctggactgtcaatgacatacagaaattagtgggaaaattgaattgggcaagtcagatttatgcagggattaaagtaaggcaattatgtaaacttcttaggggaaccaaagcactaacagaagtagtaccactaacagaagaagcagagctagaactggcagaaaacagggagattctaaaagaaccggtacatggagtgtattatgacccatcaaaagacttaatagcagaaatacagaagcaggggcaaggccaatggacatatcaaatttatcaagagccatttaaaaatctgaaaacaggaaagtatgcaagaatgaagggtgcccacactaatgatgtgaaacaattaacagaggcagtacaaaaaatagccacagaaagcatagtaatatggggaaagactcctaaatttaaattacccatacaaaaggaaacatgggaagcatggtggacagagtattggcaagccacctggattcctgagtgggagtttgtcaatacccctcccttagtgaagttatggtaccagttagagaaagaacccataataggagcagaaactttctatgtagatggggcagccaatagggaaactaaattaggaaaagcaggatatgtaactgacagaggaagacaaaaagttgtccccctaacggacacaacaaatcagaagactgagttacaagcaattcatctagctttgcaggattcgggattagaagtaaacatagtgacagactcacaatatgcattgggaatcattcaagcacaaccagataagagtgaatcagagttagtcagtcaaataatagagcagttaataaaaaaggaaaaagtctacctggcatgggtaccagcacacaaaggaattggaggaaatgaacaagtagataaattggtcagtgctggaatcaggaaagtactatttttagatggaatagataaggcccaagaagaacatgagaaatatcacagtaattggagagcaatggctagtgattttaacctaccacctgtagtagcaaaagaaatagtagccagctgtgataaatgtcagctaaaaggggaagccatgcatggacaagtagactgtagcccaggaatatggcagctagattgtacacatttagaaggaaaagttatcttggtagcagttcatgtagccagtggatatatagaagcagaagtaattccagcagagacagggcaagaaacagcatacttcctcttaaaattagcaggaagatggccagtaaaaacagtacatacagacaatggcagcaatttcaccagtactacagttaaggccgcctgttggtgggcggggatcaagcaggaatttggcattccctacaatccccaaagtcaaggagtaatagaatctatgaataaagaattaaagaaaattataggacaggtaagagatcaggctgaacatcttaagacagcagtacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggaaaggaccagcaaagctcctctggaaaggtgaaggggcagtagtaatacaagataatagtgacataaaagtagtgccaagaagaaaagcaaagatcatcagggattatggaaaacagatggcaggtgatgattgtgtaccgtccatgaagggttcgatgatcggtcgtcgcagcggtctatggcaacggcagattcgttagacaaagaaaaatagacaggttaattgatagactaatagaaagagcagaagacagtggcaatgagagtgaaggagaagtatcagcacttgtggagatgggggtggaaatggggcaccatgctccttgggatattgatgatctgtagtgctacagaaaaattgtgggtcacagtctattatggggtacctgtgtggaaggaagcaaccaccactctattttgtgcatcagatgctaaagcatatgatacagaggtacataatgtttgggccacacatgcctgtgtacccacagaccccaacccacaagaagtagtattggtaaatgtgacagaaaattttaacatgtggaaaaatgacatggtagaacagatgcatgaggatataatcagtttatgggatcaaagcctaaagccatgtgtaaaattaaccccactctgtgttagtttaaagtgcactgatttgaagaatgatactaataccaatagtagtagcgggagaatgataatggagaaaggagagataaaaaactgctctttcaatatcagcacaagcataagagataaggtgcagaaagaatatgcattcttttataaacttgatatagtaccaatagataataccagctataggttgataagttgtaacacctcagtcattacacaggcctgtccaaaggtatcctttgagccaattcccatacattattgtgccccggctggttttgcgattctaaaatgtaataataagacgttcaatggaacaggaccatgtacaaatgtcagcacagtacaatgtacacatggaatcaggccagtagtatcaactcaactgctgttaaatggcagtctagcagaagaagatgtagtaattagatctgccaatttcacagacaatgctaaaaccataatagtacagctgaacacatctgtagaaattaattgtacaagacccaacaacaatacaagaaaaagtatccgtatccagaggggaccagggagagcatttgttacaataggaaaaataggaaatatgagacaagcacattgtaacattagtagagcaaaatggaatgccactttaaaacagatagctagcaaattaagagaacaatttggaaataataaaacaataatctttaagcaatcctcaggaggggacccagaaattgtaacgcacagttttaattgtggaggggaatttttctactgtaattcaacacaactgtttaatagtacttggtttaatagtacttggagtactgaagggtcaaataacactgaaggaagtgacacaatcacactcccatgcagaataaaacaatttataaacatgtggcaggaagtaggaaaagcaatgtatgcccctcccatcagtggacaaattagatgttcatcaaatattactgggctgctattaacaagagatggtggtaataacaacaatgggtccgagatcttcagacctggaggaggcgatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctgatatagtgcagcagcagaacaatttgctgagggctattgaggcgcaacagcatctgttgcaactcacagtctggggcatcaaacagctccaggcaagaatcctggctgtggaaagatacctaaaggatcaacagctcctggggatttggggttgctctggaaaactcatttgcaccactgctgtgccttggaatgctagttggagtaataaatctctggaacagatttggaataacatgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaatcccgaggggacccgacaggcccgaaggaatagaagaagaaggtggagagagagacagagacagatccattcgattagtgaacggatccttagcacttatctgggacgatctgcggagcctgtgcctcttcagctaccaccgcttgagagacttactcttgattgtaacgaggattgtggaacttctgggacgcagggggtgggaagccctcaaatattggtggaatctcctacagtattggagtcaggaactaaagaatagtgctgttaacttgctcaatgccacagccatagcagtagctgaggggacagatagggttatagaagtattacaagcagcttatagagctattcgccacatacctagaagaataagacagggcttggaaaggattttgctataagatgggtggcaagtggtcaaaaagtagtgtgattggatggcctgctgtaagggaaagaatgagacgagctgagccagcagcagatggggtgggagcagtatctcgagacctagaaaaacatggagcaatcacaagtagcaatacagcagctaacaatgctgcttgtgcctggctagaagcacaagaggaggaagaggtgggttttccagtcacacctcaggtacctttaagaccaatgacttacaaggcagctgtagatcttagccactttttaaaagaaaaggggggactggaagggctaattcactcccaaagaagacaagatatccttgatctgtggatctaccacacacaaggctacttccctgattggcagaactacacaccagggccaggggtcagatatccactgacctttggatggtgctacaagctagtaccagttgagccagataaggtagaagaggccaataaaggagagaacaccagcttgttacaccctgtgagcctgcatggaatggatgaccctgagagagaagtgttagagtggaggtttgacagccgcctagcatttcatcacgtggcccgagagctgcatccggagtacttcaagaactgctgacatcgagcttgctacaagggactttccgctggggactttccagggaggcgtggcctgggcgggactggggagtggcgagccctcagatgctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagca

SEQ ID NO: 63 - DNA, 8572 bp, Artificial Sequence
  Synthetic Sequence
tggaagggctaatttggtcccaaaaaagacaagagatccttgatctgtggatctaccacacacaaggctacttccctgattggcagaactacacaccagggccagggatcagatatccactgacctttggatggtgcttcaagttagtaccagttgaaccagagcaagtagaagaggccaatgaaggagagaacaacagcttgttacaccctatgagccagcatgggatggaggacccggagggagaagtattagtgtggaagtttgacagcctcctagcatttcgtcacatggcccgagagctgcatccggagtactacaaagactgctgacatcgagctttctacaagggactttccgctggggactttccagggaggtgtggcctgggcgggactggggagtggcgagccctcagatgctacatataagcagctgctttttgcctgtactgggtctctctggttagaccagatctgagcctgggagctctctggctaactagggaacccactgcttaagcctcaataaagcttgccttgagtgctcaaagtagtgtgtgcccgtctgttgtgtgactctggtaactagagatccctcagacccttttagtcagtgtggaaaatctctagcagtggcgcccgaacagggacttgaaagcgaaagtaaagccagaggagatctctcgacgcaggactcggcttgctgaagcgcgcacggcaagaggcgaggggcggcgactggtgagtacgccaaaaattttgactagcggaggctagaaggagagagatgggtgcgagagcgtcggtattaagcgggggagaattagataaatgggaaaaaattcggttaaggccagggggaaagaaacaatataaactaaaacatatagtatgggcaagcagggagctagaacgattcgcagttaatcctggccttttagagacatcagaaggctgtagacaaatactgggacagctacaaccatcccttcagacaggatcagaagaacttagatcattatataatacaatagcagtcctctattgtgtgcatcaaaggatagatgtaaaagacaccaaggaagccttagataagatagaggaagagcaaaacaaaagtaagaaaaaggcacagcaagcagcagctgacacaggaaacaacagccaggtcagccaaaattaccctatagtgcagaacctccaggggcaaatggtacatcaggccatatcacctagaactttaaatgcatgggtaaaagtagtagaagagaaggctttcagcccagaagtaatacccatgttttcagcattatcagaaggagccaccccacaagatttaaataccatgctaaacacagtggggggacatcaagcagccatgcaaatgttaaaagagaccatcaatgaggaagctgcagaatgggatagattgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaataaagataggggggcaattaaaggaagctctattagatacaggagcagatgatacagtattagaagaaatgaatttgccaggaagatggaaaccaaaaatgatagggggaattggaggttttatcaaagtaagacagtatgatcagatactcatagaaatctgcggacataaagctataggtacagtattagtaggacctacacctgtcaacataattggaagaaatctgttgactcagattggctgcactttaaattttcccattagtcctattgagactgtaccagtaaaattaaagccaggaatggatggcccaaaagttaaacaatggccattgacagaagaaaaaataaaagcattagtagaaatttgtacagaaatggaaaaggaaggaaaaatttcaaaaattgggcctgaaaatccatacaatactccagtatttgccataaagaaaaaagacagtactaaatggagaaaattagtagatttcagagaacttaataagagaactcaagatttctgggaagttcaattaggaataccacatcctgcagggttaaaacagaaaaaatcagtaacagtactggatgtgggcgatgcatatttttcagttcccttagataaagacttcaggaagtatactgcatttaccatacctagtataaacaatgagacaccagggattagatatcagtacaatgtgcttccacagggatggaaaggatcaccagcaatattccagtgtagcatgacaaaaatcttagagccttttagaaaacaaaatccagacatagtcatctatcaatacatggatgatttgtatgtaggatctgacttagaaatagggcagcatagaacaaaaatagaggaactgagacaacatctgttgaggtggggatttaccacaccagacaaaaaacatcagaaagaacctccattcctttggatgggttatgaactccatcctgataaatggacagtacagcctatagtgctgccagaaaaggacagctggactgtcaatgacatacagaaattagtgggaaaattgaattgggcaagtcagatttatgcagggattaaagtaaggcaattatgtaaacttcttaggggaaccaaagcactaacagaagtagtaccactaacagaagaagcagagctagaactggcagaaaacagggagattctaaaagaaccggtacatggagtgtattatgacccatcaaaagacttaatagcagaaatacagaagcaggggcaaggccaatggacatatcaaatttatcaagagccatttaaaaatctgaaaacaggaaagtatgcaagaatgaagggtgcccacactaatgatgtgaaacaattaacagaggcagtacaaaaaatagccacagaaagcatagtaatatggggaaagactcctaaatttaaattacccatacaaaaggaaacatgggaagcatggtggacagagtattggcaagccacctggattcctgagtgggagtttgtcaatacccctcccttagtgaagttatggtaccagttagagaaagaacccataataggagcagaaactttctatgtagatggggcagccaatagggaaactaaattaggaaaagcaggatatgtaactgacagaggaagacaaaaagttgtccccctaacggacacaacaaatcagaagactgagttacaagcaattcatctagctttgcaggattcgggattagaagtaaacatagtgacagactcacaatatgcattgggaatcattcaagcacaaccagataagagtgaatcagagttagtcagtcaaataatagagcagttaataaaaaaggaaaaagtctacctggcatgggtaccagcacacaaaggaattggaggaaatgaacaagtagataaattggtcagtgctggaatcaggaaagtactatttttagatggaatagataaggcccaagaagaacatgagaaatatcacagtaattggagagcaatggctagtgattttaacctaccacctgtagtagcaaaagaaatagtagccagctgtgataaatgtcagctaaaaggggaagccatgcatggacaagtagactgtagcccaggaatatggcagctagattgtacacatttagaaggaaaagttatcttggtagcagttcatgtagccagtggatatatagaagcagaagtaattccagcagagacagggcaagaaacagcatacttcctcttaaaattagcaggaagatggccagtaaaaacagtacatacagacaatggcagcaatttcaccagtactacagttaaggccgcctgttggtgggcggggatcaagcaggaatttggcattccctacaatccccaaagtcaaggagtaatagaatctatgaataaagaattaaagaaaattataggacaggtaagagatcaggctgaacatcttaagacagcagtacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggaaaggaccagcaaagctcctctggaaaggtgaaggggcagtagtaatacaagataatagtgacataaaagtagtgccaagaagaaaagcaaagatcatcagggattatggaaaacagatggcaggtgatgattgtgtaccgtccatgaagggttcgatgatcggtcgtcgcagcggtctatggcaacggcagattcgttagacaaagaaaaatagacaggttaattgatagactaatagaaagagcagaagacagtggcaatgagagtgaaggagaagtatcagcacttgtggagatgggggtggaaatggggcaccatgctccttgggatattgatgatctgtagtgctacagaaaaattgtgggtcacagtctattatggggtacctgtgtggaaggaagcaaccaccactctattttgtgcatcagatgctaaagcatatgatacagaggtacataatgtttgggccacacatgcctgtgtacccacagaccccaacccacaagaagtagtattggtaaatgtgacagaaaattttaacatgtggaaaaatgacatggtagaacagatgcatgaggatataatcagtttatgggatcaaagcctaaagccatgtgtaaaattaaccccactctgtgttagtttaaagtgcactgatttgaagaatgatactaataccaatagtagtagcgggagaatgataatggagaaaggagagataaaaaactgctctttcaatatcagcacaagcataagagataaggtgcagaaagaatatgcattcttttataaacttgatatagtaccaatagataataccagctataggttgataagttgtaacacctcagtcattacacaggcctgtccaaaggtatcctttgagccaattcccatacattattgtgccccggctggttttgcgattctaaaatgtaataataagacgttcaatggaacaggaccatgtacaaatgtcagcacagtacaatgtacacatggaatcaggccagtagtatcaactcaactgctgttaaatggcagtctagcagaagaagatgtagtaattagatctgccaatttcacagacaatgctaaaaccataatagtacagctgaacacatctgtagaaattaattgtacaagacccaacaacaatacaagaaaaagtatccgtatccagaggggaccagggagagcatttgttacaataggaaaaataggaaatatgagacaagcacattgtaacattagtagagcaaaatggaatgccactttaaaacagatagctagcaaattaagagaacaatttggaaataataaaacaataatctttaagcaatcctcaggaggggacccagaaattgtaacgcacagttttaattgtggaggggaatttttctactgtaattcaacacaactgtttaatagtacttggtttaatagtacttggagtactgaagggtcaaataacactgaaggaagtgacacaatcacactcccatgcagaataaaacaatttataaacatgtggcaggaagtaggaaaagcaatgtatgcccctcccatcagtggacaaattagatgttcatcaaatattactgggctgctattaacaagagatggtggtaataacaacaatgggtccgagatcttcagacctggaggaggcgatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctgatatagtgcagcagcagaacaatttgctgagggctattgaggcgcaacagcatctgttgcaactcacagtctggggcatcaaacagctccaggcaagaatcctggctgtggaaagatacctaaaggatcaacagctcctggggatttggggttgctctggaaaactcatttgcaccactgctgtgccttggaatgctagttggagtaataaatctctggaacagatttggaataacatgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaatcccgaggggacccgacaggcccgaaggaatagaagaagaaggtggagagagagacagagacagatccattcgattagtgaacggatccttagcacttatctgggacgatctgcggagcctgtgcctcttcagctaccaccgcttgagagacttactcttgattgtaacgaggattgtggaacttctgggacgcagggggtgggaagccctcaaatattggtggaatctcctacagtattggagtcaggaactaaagaatagtgctgttaacttgctcaatgccacagccatagcagtagctgaggggacagatagggttatagaagtattacaagcagcttatagagctattcgccacatacctagaagaataagacagggcttggaaaggattttgctataagatgggtggcaagtggtcaaaaagtagtgtgattggatggcctgctgtaagggaaagaatgagacgagctgagccagcagcagatggggtgggagcagtatctcgagacctagaaaaacatggagcaatcacaagtagcaatacagcagctaacaatgctgcttgtgcctggctagaagcacaagaggaggaagaggtgggttttccagtcacacctcaggtacctttaagaccaatgacttacaaggcagctgtagatcttagccactttttaaaagaaaaggggggactggaagggctaattcactcccaaagaagacaagatatccttaccgtccatgaagggttcgatcgtaaagtgggatagttttttatggcaacggcagattcgttgagcctgcatggaatggatgaccctgagagagaagtgttagagtggaggtttgacagccgcctagcatttcatcacgtggcccgagagctgcatccggagtacttcaagaactgctgacatcgagcttgctacaagggactttccgctggggactttccagggaggcgtggcctgggcgggactggggagtggcgagccctcagatgctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagca

SEQ ID NO: 64 - DNA, 8561 bp, Artificial Sequence
  Synthetic Sequence
tggaagggctaatttggtcccaaaaaagacaagagatccttgatctgtggatctaccacacacaaggctacttccctgattggcagaactacacaccagggccagggatcagatatccactgacctttggatggtgcttcaagttagtaccagttgaaccagagcaagtagaagaggccaatgaaggagagaacaacagcttgttacaccctatgagccagcatgggatggaggacccggagggagaagtattagtgtggaagtttgacagcctcctagcatttcgtcacatggcccgagagctgcatccggagtactacaaagactgctgacatcgagctttctacaagggactttccgctggggactttccagggaggtgtggcctgggcgggactggggagtggcgagccctcagatgctacatataagcagctgctttttgcctgtactgggtctctctggttagaccagatctgagcctgggagctctctggctaactagggaacccactgcttaagcctcaataaagcttgccttgagtgctcaaagtagtgtgtgcccgtctgttgtgtgactctggtaactagagatccctcagacccttttagtcagtgtggaaaatctctagcagtggcgcccgaacagggacttgaaagcgaaagtaaagccagaggagatctctcgacgcaggactcggcttgctgaagcgcgcacggcaagaggcgaggggcggcgactggtgagtacgccaaaaattttgactagcggaggctagaaggagagagatgggtgcgagagcgtcggtattaagcgggggagaattagataaatgggaaaaaattcggttaaggccagggggaaagaaacaatataaactaaaacatatagtatgggcaagcagggagctagaacgattcgcagttaatcctggccttttagagacatcagaaggctgtagacaaatactgggacagctacaaccatcccttcagacaggatcagaagaacttagatcattatataatacaatagcagtcctctattgtgtgcatcaaaggatagatgtaaaagacaccaaggaagccttagataagatagaggaagagcaaaacaaaagtaagaaaaaggcacagcaagcagcagctgacacaggaaacaacagccaggtcagccaaaattaccctatagtgcagaacctccaggggcaaatggtacatcaggccatatcacctagaactttaaatgcatgggtaaaagtagtagaagagaaggctttcagcccagaagtaatacccatgttttcagcattatcagaaggagccaccccacaagatttaaataccatgctaaacacagtggggggacatcaagcagccatgcaaatgttaaaagagaccatcaatgaggaagctgcagaatgggatagattgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaataaagataggggggcaattaaaggaagctctattagatacaggagcagatgatacagtattagaagaaatgaatttgccaggaagatggaaaccaaaaatgatagggggaattggaggttttatcaaagtaagacagtatgatcagatactcatagaaatctgcggacataaagctataggtacagtattagtaggacctacacctgtcaacataattggaagaaatctgttgactcagattggctgcactttaaattttcccattagtcctattgagactgtaccagtaaaattaaagccaggaatggatggcccaaaagttaaacaatggccattgacagaagaaaaaataaaagcattagtagaaatttgtacagaaatggaaaaggaaggaaaaatttcaaaaattgggcctgaaaatccatacaatactccagtatttgccataaagaaaaaagacagtactaaatggagaaaattagtagatttcagagaacttaataagagaactcaagatttctgggaagttcaattaggaataccacatcctgcagggttaaaacagaaaaaatcagtaacagtactggatgtgggcgatgcatatttttcagttcccttagataaagacttcaggaagtatactgcatttaccatacctagtataaacaatgagacaccagggattagatatcagtacaatgtgcttccacagggatggaaaggatcaccagcaatattccagtgtagcatgacaaaaatcttagagccttttagaaaacaaaatccagacatagtcatctatcaatacatggatgatttgtatgtaggatctgacttagaaatagggcagcatagaacaaaaatagaggaactgagacaacatctgttgaggtggggatttaccacaccagacaaaaaacatcagaaagaacctccattcctttggatgggttatgaactccatcctgataaatggacagtacagcctatagtgctgccagaaaaggacagctggactgtcaatgacatacagaaattagtgggaaaattgaattgggcaagtcagatttatgcagggattaaagtaaggcaattatgtaaacttcttaggggaaccaaagcactaacagaagtagtaccactaacagaagaagcagagctagaactggcagaaaacagggagattctaaaagaaccggtacatggagtgtattatgacccatcaaaagacttaatagcagaaatacagaagcaggggcaaggccaatggacatatcaaatttatcaagagccatttaaaaatctgaaaacaggaaagtatgcaagaatgaagggtgcccacactaatgatgtgaaacaattaacagaggcagtacaaaaaatagccacagaaagcatagtaatatggggaaagactcctaaatttaaattacccatacaaaaggaaacatgggaagcatggtggacagagtattggcaagccacctggattcctgagtgggagtttgtcaatacccctcccttagtgaagttatggtaccagttagagaaagaacccataataggagcagaaactttctatgtagatggggcagccaatagggaaactaaattaggaaaagcaggatatgtaactgacagaggaagacaaaaagttgtccccctaacggacacaacaaatcagaagactgagttacaagcaattcatctagctttgcaggattcgggattagaagtaaacatagtgacagactcacaatatgcattgggaatcattcaagcacaaccagataagagtgaatcagagttagtcagtcaaataatagagcagttaataaaaaaggaaaaagtctacctggcatgggtaccagcacacaaaggaattggaggaaatgaacaagtagataaattggtcagtgctggaatcaggaaagtactatttttagatggaatagataaggcccaagaagaacatgagaaatatcacagtaattggagagcaatggctagtgattttaacctaccacctgtagtagcaaaagaaatagtagccagctgtgataaatgtcagctaaaaggggaagccatgcatggacaagtagactgtagcccaggaatatggcagctagattgtacacatttagaaggaaaagttatcttggtagcagttcatgtagccagtggatatatagaagcagaagtaattccagcagagacagggcaagaaacagcatacttcctcttaaaattagcaggaagatggccagtaaaaacagtacatacagacaatggcagcaatttcaccagtactacagttaaggccgcctgttggtgggcggggatcaagcaggaatttggcattccctacaatccccaaagtcaaggagtaatagaatctatgaataaagaattaaagaaaattataggacaggtaagagatcaggctgaacatcttaagacagcagtacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggaaaggaccagcaaagctcctctggaaaggtgaaggggcagtagtaatacaagataatagtgacataaaagtagtgccaagaagaaaagcaaagatcatcagggattaaccgtccatgaagggttcgattatctgtagccaacattcgatatggcaacggcagattcgttggagatgggggtggaaatggggcaccatgctccttgggatattgatgatctgtagtgctacagaaaaattgtgggtcacagtctattatggggtacctgtgtggaaggaagcaaccaccactctattttgtgcatcagatgctaaagcatatgatacagaggtacataatgtttgggccacacatgcctgtgtacccacagaccccaacccacaagaagtagtattggtaaatgtgacagaaaattttaacatgtggaaaaatgacatggtagaacagatgcatgaggatataatcagtttatgggatcaaagcctaaagccatgtgtaaaattaaccccactctgtgttagtttaaagtgcactgatttgaagaatgatactaataccaatagtagtagcgggagaatgataatggagaaaggagagataaaaaactgctctttcaatatcagcacaagcataagagataaggtgcagaaagaatatgcattcttttataaacttgatatagtaccaatagataataccagctataggttgataagttgtaacacctcagtcattacacaggcctgtccaaaggtatcctttgagccaattcccatacattattgtgccccggctggttttgcgattctaaaatgtaataataagacgttcaatggaacaggaccatgtacaaatgtcagcacagtacaatgtacacatggaatcaggccagtagtatcaactcaactgctgttaaatggcagtctagcagaagaagatgtagtaattagatctgccaatttcacagacaatgctaaaaccataatagtacagctgaacacatctgtagaaattaattgtacaagacccaacaacaatacaagaaaaagtatccgtatccagaggggaccagggagagcatttgttacaataggaaaaataggaaatatgagacaagcacattgtaacattagtagagcaaaatggaatgccactttaaaacagatagctagcaaattaagagaacaatttggaaataataaaacaataatctttaagcaatcctcaggaggggacccagaaattgtaacgcacagttttaattgtggaggggaatttttctactgtaattcaacacaactgtttaatagtacttggtttaatagtacttggagtactgaagggtcaaataacactgaaggaagtgacacaatcacactcccatgcagaataaaacaatttataaacatgtggcaggaagtaggaaaagcaatgtatgcccctcccatcagtggacaaattagatgttcatcaaatattactgggctgctattaacaagagatggtggtaataacaacaatgggtccgagatcttcagacctggaggaggcgatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctgatatagtgcagcagcagaacaatttgctgagggctattgaggcgcaacagcatctgttgcaactcacagtctggggcatcaaacagctccaggcaagaatcctggctgtggaaagatacctaaaggatcaacagctcctggggatttggggttgctctggaaaactcatttgcaccactgctgtgccttggaatgctagttggagtaataaatctctggaacagatttggaataacatgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaatcccgaggggacccgacaggcccgaaggaatagaagaagaaggtggagagagagacagagacagatccattcgattagtgaacggatccttagcacttatctgggacgatctgcggagcctgtgcctcttcagctaccaccgcttgagagacttactcttgattgtaacgaggattgtggaacttctgggacgcagggggtgggaagccctcaaatattggtggaatctcctacagtattggagtcaggaactaaagaatagtgctgttaacttgctcaatgccacagccatagcagtagctgaggggacagatagggttatagaagtattacaagcagcttatagagctattcgccacatacctagaagaataagacagggcttggaaaggattttgctataagatgggtggcaagtggtcaaaaagtagtgtgattggatggcctgctgtaagggaaagaatgagacgagctgagccagcagcagatggggtgggagcagtatctcgagacctagaaaaacatggagcaatcacaagtagcaatacagcagctaacaatgctgcttgtgcctggctagaagcacaagaggaggaagaggtgggttttccagtcacacctcaggtacctttaagaccaatgacttacaaggcagctgtagatcttagccactttttaaaagaaaaggggggactggaagggctaattcactcccaaagaagacaagatatccttgatctgtggatctaccacacacaaggctacttccctgattggcagaactacacaccagggccaggggtcagatatccactgacctttggatggtgctacaagctagtaccagttgagccagataaggtagaagaggccaataaaggagagaacaccagcttgttacaccctgtgagcctgcatggaatggatgaccctgagagagaagtgttagagtggaggtttgacagccgcctagcatttcatcacgtggcccgagagctgcatccggagtacttcaagaactgctgacatcgagcttgctacaagggactttccgctggggactttccagggaggcgtggcctgggcgggactggggagtggcgagccctcagatgctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagca

SEQ ID NO: 65 - DNA, 8450 bp, Artificial Sequence
  Synthetic Sequence
tggaagggctaatttggtcccaaaaaagacaagagatccttgatctgtggatctaccacacacaaggctacttccctgattggcagaactacacaccagggccagggatcagatatccactgacctttggatggtgcttcaagttagtaccagttgaaccagagcaagtagaagaggccaatgaaggagagaacaacagcttgttacaccctatgagccagcatgggatggaggacccggagggagaagtattagtgtggaagtttgacagcctcctagcatttcgtcacatggcccgagagctgcatccggagtactacaaagactgctgacatcgagctttctacaagggactttccgctggggactttccagggaggtgtggcctgggcgggactggggagtggcgagccctcagatgctacatataagcagctgctttttgcctgtactgggtctctctggttagaccagatctgagcctgggagctctctggctaactagggaacccactgcttaagcctcaataaagcttgccttgagtgctcaaagtagtgtgtgcccgtctgttgtgtgactctggtaactagagatccctcagacccttttagtcagtgtggaaaatctctagcagtggcgcccgaacagggacttgaaagcgaaagtaaagccagaggagatctctcgacgcaggactcggcttgctgaagcgcgcacggcaagaggcgaggggcggcgactggtgagtacgccaaaaattttgactagcggaggctagaaggagagagatgggtgcgagagcgtcggtattaagcgggggagaattagataaatgggaaaaaattcggttaaggccagggggaaagaaacaatataaactaaaacatatagtatgggcaagcagggagctagaacgattcgcagttaatcctggccttttagagacatcagaaggctgtagacaaatactgggacagctacaaccatcccttcagacaggatcagaagaacttagatcattatataatacaatagcagtcctctattgtgtgcatcaaaggatagatgtaaaagacaccaaggaagccttagataagatagaggaagagcaaaacaaaagtaagaaaaaggcacagcaagcagcagctgacacaggaaacaacagccaggtcagccaaaattaccctatagtgcagaacctccaggggcaaatggtacatcaggccatatcacctagaactttaaatgcatgggtaaaagtagtagaagagaaggctttcagcccagaagtaatacccatgttttcagcattatcagaaggagccaccccacaagatttaaataccatgctaaacacagtggggggacatcaagcagccatgcaaatgttaaaagagaccatcaatgaggaagctgcagaatgggatagattgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaataaagataggggggcaattaaaggaagctctattagatacaggagcagatgatacagtattagaagaaatgaatttgccaggaagatggaaaccaaaaatgatagggggaattggaggttttatcaaagtaagacagtatgatcagatactcatagaaatctgcggacataaagctataggtacagtattagtaggacctacacctgtcaacataattggaagaaatctgttgactcagattggctgcactttaaattttcccattagtcctattgagactgtaccagtaaaattaaagccaggaatggatggcccaaaagttaaacaatggccattgacagaagaaaaaataaaagcattagtagaaatttgtacagaaatggaaaaggaaggaaaaatttcaaaaattgggcctgaaaatccatacaatactccagtatttgccataaagaaaaaagacagtactaaatggagaaaattagtagatttcagagaacttaataagagaactcaagatttctgggaagttcaattaggaataccacatcctgcagggttaaaacagaaaaaatcagtaacagtactggatgtgggcgatgcatatttttcagttcccttagataaagacttcaggaagtatactgcatttaccatacctagtataaacaatgagacaccagggattagatatcagtacaatgtgcttccacagggatggaaaggatcaccagcaatattccagtgtagcatgacaaaaatcttagagccttttagaaaacaaaatccagacatagtcatctatcaatacatggatgatttgtatgtaggatctgacttagaaatagggcagcatagaacaaaaatagaggaactgagacaacatctgttgaggtggggatttaccacaccagacaaaaaacatcagaaagaacctccattcctttggatgggttatgaactccatcctgataaatggacagtacagcctatagtgctgccagaaaaggacagctggactgtcaatgacatacagaaattagtgggaaaattgaattgggcaagtcagatttatgcagggattaaagtaaggcaattatgtaaacttcttaggggaaccaaagcactaacagaagtagtaccactaacagaagaagcagagctagaactggcagaaaacagggagattctaaaagaaccggtacatggagtgtattatgacccatcaaaagacttaatagcagaaatacagaagcaggggcaaggccaatggacatatcaaatttatcaagagccatttaaaaatctgaaaacaggaaagtatgcaagaatgaagggtgcccacactaatgatgtgaaacaattaacagaggcagtacaaaaaatagccacagaaagcatagtaatatggggaaagactcctaaatttaaattacccatacaaaaggaaacatgggaagcatggtggacagagtattggcaagccacctggattcctgagtgggagtttgtcaatacccctcccttagtgaagttatggtaccagttagagaaagaacccataataggagcagaaactttctatgtagatggggcagccaatagggaaactaaattaggaaaagcaggatatgtaactgacagaggaagacaaaaagttgtccccctaacggacacaacaaatcagaagactgagttacaagcaattcatctagctttgcaggattcgggattagaagtaaacatagtgacagactcacaatatgcattgggaatcattcaagcacaaccagataagagtgaatcagagttagtcagtcaaataatagagcagttaataaaaaaggaaaaagtctacctggcatgggtaccagcacacaaaggaattggaggaaatgaacaagtagataaattggtcagtgctggaatcaggaaagtactatttttagatggaatagataaggcccaagaagaacatgagaaatatcacagtaattggagagcaatggctagtgattttaacctaccacctgtagtagcaaaagaaatagtagccagctgtgataaatgtcagctaaaaggggaagccatgcatggacaagtagactgtagcccaggaatatggcagctagattgtacacatttagaaggaaaagttatcttggtagcagttcatgtagccagtggatatatagaagcagaagtaattccagcagagacagggcaagaaacagcatacttcctcttaaaattagcaggaagatggccagtaaaaacagtacatacagacaatggcagcaatttcaccagtactacagttaaggccgcctgttggtgggcggggatcaagcaggaatttggcattccctacaatccccaaagtcaaggagtaatagaatctatgaataaagaattaaagaaaattataggacaggtaagagatcaggctgaacatcttaagacagcagtacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggaaaggaccagcaaagctcctctggaaaggtgaaggggcagtagtaatacaagataatagtgacataaaagtagtgccaagaagaaaagcaaagatcatcagggattaaccgtccatgaagggttcgattatctgtagccaacattcgatatggcaacggcagattcgttggagatgggggtggaaatggggcaccatgctccttgggatattgatgatctgtagtgctacagaaaaattgtgggtcacagtctattatggggtacctgtgtggaaggaagcaaccaccactctattttgtgcatcagatgctaaagcatatgatacagaggtacataatgtttgggccacacatgcctgtgtacccacagaccccaacccacaagaagtagtattggtaaatgtgacagaaaattttaacatgtggaaaaatgacatggtagaacagatgcatgaggatataatcagtttatgggatcaaagcctaaagccatgtgtaaaattaaccccactctgtgttagtttaaagtgcactgatttgaagaatgatactaataccaatagtagtagcgggagaatgataatggagaaaggagagataaaaaactgctctttcaatatcagcacaagcataagagataaggtgcagaaagaatatgcattcttttataaacttgatatagtaccaatagataataccagctataggttgataagttgtaacacctcagtcattacacaggcctgtccaaaggtatcctttgagccaattcccatacattattgtgccccggctggttttgcgattctaaaatgtaataataagacgttcaatggaacaggaccatgtacaaatgtcagcacagtacaatgtacacatggaatcaggccagtagtatcaactcaactgctgttaaatggcagtctagcagaagaagatgtagtaattagatctgccaatttcacagacaatgctaaaaccataatagtacagctgaacacatctgtagaaattaattgtacaagacccaacaacaatacaagaaaaagtatccgtatccagaggggaccagggagagcatttgttacaataggaaaaataggaaatatgagacaagcacattgtaacattagtagagcaaaatggaatgccactttaaaacagatagctagcaaattaagagaacaatttggaaataataaaacaataatctttaagcaatcctcaggaggggacccagaaattgtaacgcacagttttaattgtggaggggaatttttctactgtaattcaacacaactgtttaatagtacttggtttaatagtacttggagtactgaagggtcaaataacactgaaggaagtgacacaatcacactcccatgcagaataaaacaatttataaacatgtggcaggaagtaggaaaagcaatgtatgcccctcccatcagtggacaaattagatgttcatcaaatattactgggctgctattaacaagagatggtggtaataacaacaatgggtccgagatcttcagacctggaggaggcgatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctgatatagtgcagcagcagaacaatttgctgagggctattgaggcgcaacagcatctgttgcaactcacagtctggggcatcaaacagctccaggcaagaatcctggctgtggaaagatacctaaaggatcaacagctcctggggatttggggttgctctggaaaactcatttgcaccactgctgtgccttggaatgctagttggagtaataaatctctggaacagatttggaataacatgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaatcccgaggggacccgacaggcccgaaggaatagaagaagaaggtggagagagagacagagacagatccattcgattagtgaacggatccttagcacttatctgggacgatctgcggagcctgtgcctcttcagctaccaccgcttgagagacttactcttgattgtaacgaggattgtggaacttctgggacgcagggggtgggaagccctcaaatattggtggaatctcctacagtattggagtcaggaactaaagaatagtgctgttaacttgctcaatgccacagccatagcagtagctgaggggacagatagggttatagaagtattacaagcagcttatagagctattcgccacatacctagaagaataagacagggcttggaaaggattttgctataagatgggtggcaagtggtcaaaaagtagtgtgattggatggcctgctgtaagggaaagaatgagacgagctgagccagcagcagatggggtgggagcagtatctcgagacctagaaaaacatggagcaatcacaagtagcaatacagcagctaacaatgctgcttgtgcctggctagaagcacaagaggaggaagaggtgggttttccagtcacacctcaggtacctttaagaccaatgacttacaaggcagctgtagatcttagccactttttaaaagaaaaggggggactggaagggctaattcactcccaaagaagacaagatatccttaccgtccatgaagggttcgatcgtaaagtgggatagttttttatggcaacggcagattcgttgagcctgcatggaatggatgaccctgagagagaagtgttagagtggaggtttgacagccgcctagcatttcatcacgtggcccgagagctgcatccggagtacttcaagaactgctgacatcgagcttgctacaagggactttccgctggggactttccagggaggcgtggcctgggcgggactggggagtggcgagccctcagatgctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagca

SEQ ID NO: 66 - DNA, 8785 bp, Artificial Sequence
  Synthetic Sequence
tggaagggctaatttggtcccaaaaaagacaagagatccttgatctgtggatctaccacacacaaggctacttccctgattggcagaactacacaccagggccagggatcagatatccactgacctttggatggtgcttcaagttagtaccagttgaaccagagcaagtagaagaggccaatgaaggagagaacaacagcttgttacaccctatgagccagcatgggatggaggacccggagggagaagtattagtgtggaagtttgacagcctcctagcatttcgtcacatggcccgagagctgcatccggagtactacaaagactgctgacatcgagctttctacaagggactttccgctggggactttccagggaggtgtggcctgggcgggactggggagtggcgagccctcagatgctacatataagcagctgctttttgcctgtactgggtctctctggttagaccagatctgagcctgggagctctctggctaactagggaacccactgcttaagcctcaataaagcttgccttgagtgctcaaagtagtgtgtgcccgtctgttgtgtgactctggtaactagagatccctcagacccttttagtcagtgtggaaaatctctagcagtggcgcccgaacagggacttgaaagcgaaagtaaagccagaggagatctctcgacgcaggactcggcttgctgaagcgcgcacggcaagaggcgaggggcggcgactggtgagtacgccaaaaattttgactagcggaggctagaaggagagagatgggtgcgagagcgtcggtattaagcgggggagaattagataaatgggaaaaaattcggttaaggccagggggaaagaaacaatataaactaaaacatatagtatgggcaagcagggagctagaacgattcgcagttaatcctggccttttagagacatcagaaggctgtagacaaatactgggacagctacaaccatcccttcagacaggatcagaagaacttagatcattatataatacaatagcagtcctctattgtgtgcatcaaaggatagatgtaaaagacaccaaggaagccttagataagatagaggaagagcaaaacaaaagtaagaaaaaggcacagcaagcagcagctgacacaggaaacaacagccaggtcagccaaaattaccctatagtgcagaacctccaggggcaaatggtacatcaggccatatcacctagaactttaaatgcatgggtaaaagtagtagaagagaaggctttcagcccagaagtaatacccatgttttcagcattatcagaaggagccaccccacaagatttaaataccatgctaaacacagtggggggacatcaagcagccatgcaaatgttaaaagagaccatcaatgaggaagctgcagaatgggatagattgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaataaagataggggggcaattaaaggaagctctattagatacaggagcagatgatacagtattagaagaaatgaatttgccaggaagatggaaaccaaaaatgatagggggaattggaggttttatcaaagtaagacagtatgatcagatactcatagaaatctgcggacataaagctataggtacagtattagtaggacctacacctgtcaacataattggaagaaatctgttgactcagattggctgcactttaaattttcccattagtcctattgagactgtaccagtaaaattaaagccaggaatggatggcccaaaagttaaacaatggccattgacagaagaaaaaataaaagcattagtagaaatttgtacagaaatggaaaaggaaggaaaaatttcaaaaattgggcctgaaaatccatacaatactccagtatttgccataaagaaaaaagacagtactaaatggagaaaattagtagatttcagagaacttaataagagaactcaagatttctgggaagttcaattaggaataccacatcctgcagggttaaaacagaaaaaatcagtaacagtactggatgtgggcgatgcatatttttcagttcccttagataaagacttcaggaagtatactgcatttaccatacctagtataaacaatgagacaccagggattagatatcagtacaatgtgcttccacagggatggaaaggatcaccagcaatattccagtgtagcatgacaaaaatcttagagccttttagaaaacaaaatccagacatagtcatctatcaatacatggatgatttgtatgtaggatctgacttagaaatagggcagcatagaacaaaaatagaggaactgagacaacatctgttgaggtggggatttaccacaccagacaaaaaacatcagaaagaacctccattcctttggatgggttatgaactccatcctgataaatggacagtacagcctatagtgctgccagaaaaggacagctggactgtcaatgacatacagaaattagtgggaaaattgaattgggcaagtcagatttatgcagggattaaagtaaggcaattatgtaaacttcttaggggaaccaaagcactaacagaagtagtaccactaacagaagaagcagagctagaactggcagaaaacagggagattctaaaagaaccggtacatggagtgtattatgacccatcaaaagacttaatagcagaaatacagaagcaggggcaaggccaatggacatatcaaatttatcaagagccatttaaaaatctgaaaacaggaaagtatgcaagaatgaacgaatctgccgttgccatatacagcatctgaacaagctgatcgaacccttcatggacggttaaggccgcctgttggtgggcggggatcaagcaggaatttggcattccctacaatccccaaagtcaaggagtaatagaatctatgaataaagaattaaagaaaattataggacaggtaagagatcaggctgaacatcttaagacagcagtacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggaaaggaccagcaaagctcctctggaaaggtgaaggggcagtagtaatacaagataatagtgacataaaagtagtgccaagaagaaaagcaaagatcatcagggattatggaaaacagatggcaggtgatgattgtgtggcaagtagacaggatgaggattaacacatggaaaagattagtaaaacaccatatgtatatttcaaggaaagctaaggactggttttatagacatcactatgaaagtactaatccaaaaataagttcagaagtacacatcccactaggggatgctaaattagtaataacaacatattggggtctgcatacaggagaaagagactggcatttgggtcagggagtctccatagaatggaggaaaaagagatatagcacacaagtagaccctgacctagcagaccaactaattcatctgcactattttgattgtttttcagaatctgctataagaaataccatattaggacgtatagttagtcctaggtgtgaatatcaagcaggacataacaaggtaggatctctacagtacttggcactagcagcattaataaaaccaaaacagataaagccacctttgcctagtgttaggaaactgacagaggacagatggaacaagccccagaagaccaagggccacagagggagccatacaatgaatggacactagagcttttagaggaacttaagagtgaagctgttagacattttcctaggatatggctccataacttaggacaacatatctatgaaacttacggggatacttgggcaggagtggaagccataataagaattctgcaacaactgctgtttatccatttcagaattgggtgtcgacatagcagaataggcgttactcgacagaggagagcaagaaatggagccagtagatcctagactagagccctggaagcatccaggaagtcagcctaaaactgcttgtaccaattgctattgtaaaaagtgttgctttcattgccaagtttgtttcatgacaaaagccttaggcatctcctatggcaggaagaagcggagacagcgacgaagagctcatcagaacagtcagactcatcaagcttctctatcaaagcagtaagtagtacatgtaatgcaacctataatagtagcaatagtagcattagtagtagcaataataatagcaatagttgtgtggtccatagtaatcatagaatataggaaaatattaagacaaagaaaaatagacaggttaattgatagactaatagaaagagcagaagacagtggcaatgagagtgaaggagaagtatcagcacttgtggagatgggggtggaaatggggcaccatgctccttgggatattgatgatctgtagtgctacagaaaaattgtgggtcacagtctattatggggtacctgtgtggaaggaagcaaccaccactctattttgtgcatcagatgctaaagcatatgatacagaggtacataatgtttgggccacacatgcctgtgtacccacagaccccaacccacaagaagtagtattggtaaatgtgacagaaaattttaacatgtggaaaaatgacatggtagaacagatgcatgaggatataatcagtttatgggatcaaagcctaaagccatgtgtaaaattaaccccactctgtgttagtttaaagtgcactgatttgaagaatgatactaataccaatagtagtagcgggagaatgataatggagaaaggagagataaaaaactgctctttcaatatcagcacaagcataagagataaggtgcagaaagaatatgcattcttttataaacttgatatagtaccaatagataataccagctataggttgataagttgtaacacctcagtcattacacaggcctgtccaaaggtatcctttgagccaattcccatacattattgtgccccggctggttttgcgattctaaaatgtaataataagacgttcaatggaacaggaccatgtacaaatgtcagcacagtacaatgtacacatggaatcaggccagtagtatcaactcaactgctgttaaatggcagtctagcagaagaagatgtagtaattagatctgccaatttcacagacaatgctaaaaccataatagtacagctgaacacatctgtagaaattaattgtacaagacccaacaacaatacaagaaaaagtatccgtatccagaggggaccagggagagcatttgttacaataggaaaaataggaaatatgagacaagcacattgtaacattagtagagcaaaatggaatgccactttaaaacagatagctagcaaattaagagaacaatttggaaataataaaacaataatctttaagcaatcctcaggaggggacccagaaattgtaacgcacagttttaattgtggaggggaatttttctactgtaattcaacacaactgtttaatagtacttggtttaatagtacttggagtactgaagggtcaaataacactgaaggaagtgacacaatcacactcccatgcagaataaaacaatttataaacatgtggcaggaagtaggaaaagcaatgtatgcccctcccatcagtggacaaattagatgttcatcaaatattactgggctgctattaacaagagatggtggtaataacaacaatgggtccgagatcttcagacctggaggaggcgatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctgatatagtgcagcagcagaacaatttgctgagggctattgaggcgcaacagcatctgttgcaactcacagtctggggcatcaaacagctccaggcaagaatcctggctgtggaaagatacctaaaggatcaacagctcctggggatttggggttgctctggaaaactcatttgcaccactgctgtgccttggaatgctagttggagtaataaatctctggaacagatttggaataacatgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaatcccgaggggacccgacaggcccgaaggaatagaagaagaaggtggagagagagacagagacagatccattcgattagtgaacggatccttagcacttatctgggacgatctgcggagcctgtgcctcttcagctaccaccgcttgagagacttactcttgattgtaacgaggattgtggaacttctgggacgcagggggtgggaagccctcaaatattggtggaatctcctacagtattggagtcaggaactaaagaatagtgctgttaacttgctcaatgccacagccatagcagtagctgaggggacagatagggttatagaagtattacaagcagcttatagagctattcgccacatacctagaagaataagacagggcttggaaaggattttgctataagatgggtggcaagtggtcaaaaagtagtgtgattggatggcctgctgtaagggaaagaatgagacgagctgagccagcagcagatggggtgggagcagtatctcgagacctagaaaaacatggagcaatcacaagtagcaatacagcagctaacaatgctgcttgtgcctggctagaagcacaagaggaggaagaggtgggttttccagtcacacctcaggtacctttaagaccaatgacttacaaggcagctgtagatcttagccactttttaaaagaaaaggggggactggaagggctaattcactcccaaagaagacaagatatccttgatctgtggatctaccacacacaaggctacttccctgattggcagaactacacaccagggccaggggtcagatatccactgacctttggatggtgctacaagctagtaccagttgagccagataaggtagaagaggccaataaaggagagaacaccagcttgttacaccctgtgagcctgcatggaatggatgaccctgagagagaagtgttagagtggaggtttgacagccgcctagcatttcatcacgtggcccgagagctgcatccggagtacttcaagaactgctgacatcgagcttgctacaagggactttccgctggggactttccagggaggcgtggcctgggcgggactggggagtggcgagccctcagatgctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagca

SEQ ID NO: 67 - DNA, 8674 bp, Artificial Sequence
  Synthetic Sequence
tggaagggctaatttggtcccaaaaaagacaagagatccttgatctgtggatctaccacacacaaggctacttccctgattggcagaactacacaccagggccagggatcagatatccactgacctttggatggtgcttcaagttagtaccagttgaaccagagcaagtagaagaggccaatgaaggagagaacaacagcttgttacaccctatgagccagcatgggatggaggacccggagggagaagtattagtgtggaagtttgacagcctcctagcatttcgtcacatggcccgagagctgcatccggagtactacaaagactgctgacatcgagctttctacaagggactttccgctggggactttccagggaggtgtggcctgggcgggactggggagtggcgagccctcagatgctacatataagcagctgctttttgcctgtactgggtctctctggttagaccagatctgagcctgggagctctctggctaactagggaacccactgcttaagcctcaataaagcttgccttgagtgctcaaagtagtgtgtgcccgtctgttgtgtgactctggtaactagagatccctcagacccttttagtcagtgtggaaaatctctagcagtggcgcccgaacagggacttgaaagcgaaagtaaagccagaggagatctctcgacgcaggactcggcttgctgaagcgcgcacggcaagaggcgaggggcggcgactggtgagtacgccaaaaattttgactagcggaggctagaaggagagagatgggtgcgagagcgtcggtattaagcgggggagaattagataaatgggaaaaaattcggttaaggccagggggaaagaaacaatataaactaaaacatatagtatgggcaagcagggagctagaacgattcgcagttaatcctggccttttagagacatcagaaggctgtagacaaatactgggacagctacaaccatcccttcagacaggatcagaagaacttagatcattatataatacaatagcagtcctctattgtgtgcatcaaaggatagatgtaaaagacaccaaggaagccttagataagatagaggaagagcaaaacaaaagtaagaaaaaggcacagcaagcagcagctgacacaggaaacaacagccaggtcagccaaaattaccctatagtgcagaacctccaggggcaaatggtacatcaggccatatcacctagaactttaaatgcatgggtaaaagtagtagaagagaaggctttcagcccagaagtaatacccatgttttcagcattatcagaaggagccaccccacaagatttaaataccatgctaaacacagtggggggacatcaagcagccatgcaaatgttaaaagagaccatcaatgaggaagctgcagaatgggatagattgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaataaagataggggggcaattaaaggaagctctattagatacaggagcagatgatacagtattagaagaaatgaatttgccaggaagatggaaaccaaaaatgatagggggaattggaggttttatcaaagtaagacagtatgatcagatactcatagaaatctgcggacataaagctataggtacagtattagtaggacctacacctgtcaacataattggaagaaatctgttgactcagattggctgcactttaaattttcccattagtcctattgagactgtaccagtaaaattaaagccaggaatggatggcccaaaagttaaacaatggccattgacagaagaaaaaataaaagcattagtagaaatttgtacagaaatggaaaaggaaggaaaaatttcaaaaattgggcctgaaaatccatacaatactccagtatttgccataaagaaaaaagacagtactaaatggagaaaattagtagatttcagagaacttaataagagaactcaagatttctgggaagttcaattaggaataccacatcctgcagggttaaaacagaaaaaatcagtaacagtactggatgtgggcgatgcatatttttcagttcccttagataaagacttcaggaagtatactgcatttaccatacctagtataaacaatgagacaccagggattagatatcagtacaatgtgcttccacagggatggaaaggatcaccagcaatattccagtgtagcatgacaaaaatcttagagccttttagaaaacaaaatccagacatagtcatctatcaatacatggatgatttgtatgtaggatctgacttagaaatagggcagcatagaacaaaaatagaggaactgagacaacatctgttgaggtggggatttaccacaccagacaaaaaacatcagaaagaacctccattcctttggatgggttatgaactccatcctgataaatggacagtacagcctatagtgctgccagaaaaggacagctggactgtcaatgacatacagaaattagtgggaaaattgaattgggcaagtcagatttatgcagggattaaagtaaggcaattatgtaaacttcttaggggaaccaaagcactaacagaagtagtaccactaacagaagaagcagagctagaactggcagaaaacagggagattctaaaagaaccggtacatggagtgtattatgacccatcaaaagacttaatagcagaaatacagaagcaggggcaaggccaatggacatatcaaatttatcaagagccatttaaaaatctgaaaacaggaaagtatgcaagaatgaacgaatctgccgttgccatatacagcatctgaacaagctgatcgaacccttcatggacggttaaggccgcctgttggtgggcggggatcaagcaggaatttggcattccctacaatccccaaagtcaaggagtaatagaatctatgaataaagaattaaagaaaattataggacaggtaagagatcaggctgaacatcttaagacagcagtacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggaaaggaccagcaaagctcctctggaaaggtgaaggggcagtagtaatacaagataatagtgacataaaagtagtgccaagaagaaaagcaaagatcatcagggattatggaaaacagatggcaggtgatgattgtgtggcaagtagacaggatgaggattaacacatggaaaagattagtaaaacaccatatgtatatttcaaggaaagctaaggactggttttatagacatcactatgaaagtactaatccaaaaataagttcagaagtacacatcccactaggggatgctaaattagtaataacaacatattggggtctgcatacaggagaaagagactggcatttgggtcagggagtctccatagaatggaggaaaaagagatatagcacacaagtagaccctgacctagcagaccaactaattcatctgcactattttgattgtttttcagaatctgctataagaaataccatattaggacgtatagttagtcctaggtgtgaatatcaagcaggacataacaaggtaggatctctacagtacttggcactagcagcattaataaaaccaaaacagataaagccacctttgcctagtgttaggaaactgacagaggacagatggaacaagccccagaagaccaagggccacagagggagccatacaatgaatggacactagagcttttagaggaacttaagagtgaagctgttagacattttcctaggatatggctccataacttaggacaacatatctatgaaacttacggggatacttgggcaggagtggaagccataataagaattctgcaacaactgctgtttatccatttcagaattgggtgtcgacatagcagaataggcgttactcgacagaggagagcaagaaatggagccagtagatcctagactagagccctggaagcatccaggaagtcagcctaaaactgcttgtaccaattgctattgtaaaaagtgttgctttcattgccaagtttgtttcatgacaaaagccttaggcatctcctatggcaggaagaagcggagacagcgacgaagagctcatcagaacagtcagactcatcaagcttctctatcaaagcagtaagtagtacatgtaatgcaacctataatagtagcaatagtagcattagtagtagcaataataatagcaatagttgtgtggtccatagtaatcatagaatataggaaaatattaagacaaagaaaaatagacaggttaattgatagactaatagaaagagcagaagacagtggcaatgagagtgaaggagaagtatcagcacttgtggagatgggggtggaaatggggcaccatgctccttgggatattgatgatctgtagtgctacagaaaaattgtgggtcacagtctattatggggtacctgtgtggaaggaagcaaccaccactctattttgtgcatcagatgctaaagcatatgatacagaggtacataatgtttgggccacacatgcctgtgtacccacagaccccaacccacaagaagtagtattggtaaatgtgacagaaaattttaacatgtggaaaaatgacatggtagaacagatgcatgaggatataatcagtttatgggatcaaagcctaaagccatgtgtaaaattaaccccactctgtgttagtttaaagtgcactgatttgaagaatgatactaataccaatagtagtagcgggagaatgataatggagaaaggagagataaaaaactgctctttcaatatcagcacaagcataagagataaggtgcagaaagaatatgcattcttttataaacttgatatagtaccaatagataataccagctataggttgataagttgtaacacctcagtcattacacaggcctgtccaaaggtatcctttgagccaattcccatacattattgtgccccggctggttttgcgattctaaaatgtaataataagacgttcaatggaacaggaccatgtacaaatgtcagcacagtacaatgtacacatggaatcaggccagtagtatcaactcaactgctgttaaatggcagtctagcagaagaagatgtagtaattagatctgccaatttcacagacaatgctaaaaccataatagtacagctgaacacatctgtagaaattaattgtacaagacccaacaacaatacaagaaaaagtatccgtatccagaggggaccagggagagcatttgttacaataggaaaaataggaaatatgagacaagcacattgtaacattagtagagcaaaatggaatgccactttaaaacagatagctagcaaattaagagaacaatttggaaataataaaacaataatctttaagcaatcctcaggaggggacccagaaattgtaacgcacagttttaattgtggaggggaatttttctactgtaattcaacacaactgtttaatagtacttggtttaatagtacttggagtactgaagggtcaaataacactgaaggaagtgacacaatcacactcccatgcagaataaaacaatttataaacatgtggcaggaagtaggaaaagcaatgtatgcccctcccatcagtggacaaattagatgttcatcaaatattactgggctgctattaacaagagatggtggtaataacaacaatgggtccgagatcttcagacctggaggaggcgatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctgatatagtgcagcagcagaacaatttgctgagggctattgaggcgcaacagcatctgttgcaactcacagtctggggcatcaaacagctccaggcaagaatcctggctgtggaaagatacctaaaggatcaacagctcctggggatttggggttgctctggaaaactcatttgcaccactgctgtgccttggaatgctagttggagtaataaatctctggaacagatttggaataacatgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaatcccgaggggacccgacaggcccgaaggaatagaagaagaaggtggagagagagacagagacagatccattcgattagtgaacggatccttagcacttatctgggacgatctgcggagcctgtgcctcttcagctaccaccgcttgagagacttactcttgattgtaacgaggattgtggaacttctgggacgcagggggtgggaagccctcaaatattggtggaatctcctacagtattggagtcaggaactaaagaatagtgctgttaacttgctcaatgccacagccatagcagtagctgaggggacagatagggttatagaagtattacaagcagcttatagagctattcgccacatacctagaagaataagacagggcttggaaaggattttgctataagatgggtggcaagtggtcaaaaagtagtgtgattggatggcctgctgtaagggaaagaatgagacgagctgagccagcagcagatggggtgggagcagtatctcgagacctagaaaaacatggagcaatcacaagtagcaatacagcagctaacaatgctgcttgtgcctggctagaagcacaagaggaggaagaggtgggttttccagtcacacctcaggtacctttaagaccaatgacttacaaggcagctgtagatcttagccactttttaaaagaaaaggggggactggaagggctaattcactcccaaagaagacaagatatccttaccgtccatgaagggttcgatcgtaaagtgggatagttttttatggcaacggcagattcgttgagcctgcatggaatggatgaccctgagagagaagtgttagagtggaggtttgacagccgcctagcatttcatcacgtggcccgagagctgcatccggagtacttcaagaactgctgacatcgagcttgctacaagggactttccgctggggactttccagggaggcgtggcctgggcgggactggggagtggcgagccctcagatgctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagca

SEQ ID NO: 68 - DNA, 7862 bp, Artificial Sequence
  Synthetic Sequence
tggaagggctaatttggtcccaaaaaagacaagagatccttgatctgtggatctaccacacacaaggctacttccctgattggcagaactacacaccagggccagggatcagatatccactgacctttggatggtgcttcaagttagtaccagttgaaccagagcaagtagaagaggccaatgaaggagagaacaacagcttgttacaccctatgagccagcatgggatggaggacccggagggagaagtattagtgtggaagtttgacagcctcctagcatttcgtcacatggcccgagagctgcatccggagtactacaaagactgctgacatcgagctttctacaagggactttccgctggggactttccagggaggtgtggcctgggcgggactggggagtggcgagccctcagatgctacatataagcagctgctttttgcctgtactgggtctctctggttagaccagatctgagcctgggagctctctggctaactagggaacccactgcttaagcctcaataaagcttgccttgagtgctcaaagtagtgtgtgcccgtctgttgtgtgactctggtaactagagatccctcagacccttttagtcagtgtggaaaatctctagcagtggcgcccgaacagggacttgaaagcgaaagtaaagccagaggagatctctcgacgcaggactcggcttgctgaagcgcgcacggcaagaggcgaggggcggcgactggtgagtacgccaaaaattttgactagcggaggctagaaggagagagatgggtgcgagagcgtcggtattaagcgggggagaattagataaatgggaaaaaattcggttaaggccagggggaaagaaacaatataaactaaaacatatagtatgggcaagcagggagctagaacgattcgcagttaatcctggccttttagagacatcagaaggctgtagacaaatactgggacagctacaaccatcccttcagacaggatcagaagaacttagatcattatataatacaatagcagtcctctattgtgtgcatcaaaggatagatgtaaaagacaccaaggaagccttagataagatagaggaagagcaaaacaaaagtaagaaaaaggcacagcaagcagcagctgacacaggaaacaacagccaggtcagccaaaattaccctatagtgcagaacctccaggggcaaatggtacatcaggccatatcacctagaactttaaatgcatgggtaaaagtagtagaagagaaggctttcagcccagaagtaatacccatgttttcagcattatcagaaggagccaccccacaagatttaaataccatgctaaacacagtggggggacatcaagcagccatgcaaatgttaaaagagaccatcaatgaggaagctgcagaatgggatagattgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaataaagataggggggcaattaaaggaagctctattagatacaggagcagatgatacagtattagaagaaatgaatttgccaggaagatggaaaccaaaaatgatagggggaattggaggttttatcaaagtaagacagtatgatcagatactcatagaaatctgcggacataaagctataggtacagtattagtaggacctacacctgtcaacataattggaagaaatctgttgactcagattggctgcactttaaattttcccattagtcctattgagactgtaccagtaaaattaaagccaggaatggatggcccaaaagttaaacaatggccattgacagaagaaaaaataaaagcattagtagaaatttgtacagaaatggaaaaggaaggaaaaatttcaaaaattgggcctgaaaatccatacaatactccagtatttgccataaagaaaaaagacagtactaaatggagaaaattagtagatttcagagaacttaataagagaactcaagatttctgggaagttcaattaggaataccacatcctgcagggttaaaacagaaaaaatcagtaacagtactggatgtgggcgatgcatatttttcagttcccttagataaagacttcaggaagtatactgcatttaccatacctagtataaacaatgagacaccagggattagatatcagtacaatgtgcttccacagggatggaaaggatcaccagcaatattccagtgtagcatgacaaaaatcttagagccttttagaaaacaaaatccagacatagtcatctatcaatacatggatgatttgtatgtaggatctgacttagaaatagggcagcatagaacaaaaatagaggaactgagacaacatctgttgaggtggggatttaccacaccagacaaaaaacatcagaaagaacctccattcctttggatgggttatgaactccatcctgataaatggacagtacagcctatagtgctgccagaaaaggacagctggactgtcaatgacatacagaaattagtgggaaaattgaattgggcaagtcagatttatgcagggattaaagtaaggcaattatgtaaacttcttaggggaaccaaagcactaacagaagtagtaccactaacagaagaagcagagctagaactggcagaaaacagggagattctaaaagaaccggtacatggagtgtattatgacccatcaaaagacttaatagcagaaatacagaagcaggggcaaggccaatggacatatcaaatttatcaagagccatttaaaaatctgaaaacaggaaagtatgcaagaatgaacgaatctgccgttgccatatacagcatctgaacaagctgatcgaacccttcatggacggttaaggccgcctgttggtgggcggggatcaagcaggaatttggcattccctacaatccccaaagtcaaggagtaatagaatctatgaataaagaattaaagaaaattataggacaggtaagagatcaggctgaacatcttaagacagcagtacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggaaaggaccagcaaagctcctctggaaaggtgaaggggcagtagtaatacaagataatagtgacataaaagtagtgccaagaagaaaagcaaagatcatcagggattatggaaaacagatggcaggtgatgattgtgtggcccgtccatgaagggttcgattcttgaacagcgcggtctgttatggcaacggcagattcgtttaatgcaacctataatagtagcaatagtagcattagtagtagcaataataatagcaatagttgtgtggtccatagtaatcatagaatataggaaaatattaagacaaagaaaaatagacaggttaattgatagactaatagaaagagcagaagacagtggcaatgagagtgaaggagaagtatcagcacttgtggagatgggggtggaaatggggcaccatgctccttgggatattgatgatctgtagtgctacagaaaaattgtgggtcacagtctattatggggtacctgtgtggaaggaagcaaccaccactctattttgtgcatcagatgctaaagcatatgatacagaggtacataatgtttgggccacacatgcctgtgtacccacagaccccaacccacaagaagtagtattggtaaatgtgacagaaaattttaacatgtggaaaaatgacatggtagaacagatgcatgaggatataatcagtttatgggatcaaagcctaaagccatgtgtaaaattaaccccactctgtgttagtttaaagtgcactgatttgaagaatgatactaataccaatagtagtagcgggagaatgataatggagaaaggagagataaaaaactgctctttcaatatcagcacaagcataagagataaggtgcagaaagaatatgcattcttttataaacttgatatagtaccaatagataataccagctataggttgataagttgtaacacctcagtcattacacaggcctgtccaaaggtatcctttgagccaattcccatacattattgtgccccggctggttttgcgattctaaaatgtaataataagacgttcaatggaacaggaccatgtacaaatgtcagcacagtacaatgtacacatggaatcaggccagtagtatcaactcaactgctgttaaatggcagtctagcagaagaagatgtagtaattagatctgccaatttcacagacaatgctaaaaccataatagtacagctgaacacatctgtagaaattaattgtacaagacccaacaacaatacaagaaaaagtatccgtatccagaggggaccagggagagcatttgttacaataggaaaaataggaaatatgagacaagcacattgtaacattagtagagcaaaatggaatgccactttaaaacagatagctagcaaattaagagaacaatttggaaataataaaacaataatctttaagcaatcctcaggaggggacccagaaattgtaacgcacagttttaattgtggaggggaatttttctactgtaattcaacacaactgtttaatagtacttggtttaatagtacttggagtactgaagggtcaaataacactgaaggaagtgacacaatcacactcccatgcagaataaaacaatttataaacatgtggcaggaagtaggaaaagcaatgtatgcccctcccatcagtggacaaattagatgttcatcaaatattactgggctgctattaacaagagatggtggtaataacaacaatgggtccgagatcttcagacctggaggaggcgatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctgatatagtgcagcagcagaacaatttgctgagggctattgaggcgcaacagcatctgttgcaactcacagtctggggcatcaaacagctccaggcaagaatcctggctgtggaaagatacctaaaggatcaacagctcctggggatttggggttgctctggaaaactcatttgcaccactgctgtgccttggaatgctagttggagtaataaatctctggaacagatttggaataacatgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaatcccgaggggacccgacaggcccgaaggaatagaagaagaaggtggagagagagacagagacagatccattcgattagtgaacggatccttagcacttatctgggacgatctgcggagcctgtgcctcttcagctaccaccgcttgagagacttactcttgattgtaacgaggattgtggaacttctgggacgcagggggtgggaagccctcaaatattggtggaatctcctacagtattggagtcaggaactaaagaatagtgctgttaacttgctcaatgccacagccatagcagtagctgaggggacagatagggttatagaagtattacaagcagcttatagagctattcgccacatacctagaagaataagacagggcttggaaaggattttgctataagatgggtggcaagtggtcaaaaagtagtgtgattggatggcctgctgtaagggaaagaatgagacgagctgagccagcagcagatggggtgggagcagtatctcgagacctagaaaaacatggagcaatcacaagtagcaatacagcagctaacaatgctgcttgtgcctggctagaagcacaagaggaggaagaggtgggttttccagtcacacctcaggtacctttaagaccaatgacttacaaggcagctgtagatcttagccactttttaaaagaaaaggggggactggaagggctaattcactcccaaagaagacaagatatccttgatctgtggatctaccacacacaaggctacttccctgattggcagaactacacaccagggccaggggtcagatatccactgacctttggatggtgctacaagctagtaccagttgagccagataaggtagaagaggccaataaaggagagaacaccagcttgttacaccctgtgagcctgcatggaatggatgaccctgagagagaagtgttagagtggaggtttgacagccgcctagcatttcatcacgtggcccgagagctgcatccggagtacttcaagaactgctgacatcgagcttgctacaagggactttccgctggggactttccagggaggcgtggcctgggcgggactggggagtggcgagccctcagatgctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagca

SEQ ID NO: 69 - DNA, 7751 bp, Artificial Sequence
  Synthetic Sequence
tggaagggctaatttggtcccaaaaaagacaagagatccttgatctgtggatctaccacacacaaggctacttccctgattggcagaactacacaccagggccagggatcagatatccactgacctttggatggtgcttcaagttagtaccagttgaaccagagcaagtagaagaggccaatgaaggagagaacaacagcttgttacaccctatgagccagcatgggatggaggacccggagggagaagtattagtgtggaagtttgacagcctcctagcatttcgtcacatggcccgagagctgcatccggagtactacaaagactgctgacatcgagctttctacaagggactttccgctggggactttccagggaggtgtggcctgggcgggactggggagtggcgagccctcagatgctacatataagcagctgctttttgcctgtactgggtctctctggttagaccagatctgagcctgggagctctctggctaactagggaacccactgcttaagcctcaataaagcttgccttgagtgctcaaagtagtgtgtgcccgtctgttgtgtgactctggtaactagagatccctcagacccttttagtcagtgtggaaaatctctagcagtggcgcccgaacagggacttgaaagcgaaagtaaagccagaggagatctctcgacgcaggactcggcttgctgaagcgcgcacggcaagaggcgaggggcggcgactggtgagtacgccaaaaattttgactagcggaggctagaaggagagagatgggtgcgagagcgtcggtattaagcgggggagaattagataaatgggaaaaaattcggttaaggccagggggaaagaaacaatataaactaaaacatatagtatgggcaagcagggagctagaacgattcgcagttaatcctggccttttagagacatcagaaggctgtagacaaatactgggacagctacaaccatcccttcagacaggatcagaagaacttagatcattatataatacaatagcagtcctctattgtgtgcatcaaaggatagatgtaaaagacaccaaggaagccttagataagatagaggaagagcaaaacaaaagtaagaaaaaggcacagcaagcagcagctgacacaggaaacaacagccaggtcagccaaaattaccctatagtgcagaacctccaggggcaaatggtacatcaggccatatcacctagaactttaaatgcatgggtaaaagtagtagaagagaaggctttcagcccagaagtaatacccatgttttcagcattatcagaaggagccaccccacaagatttaaataccatgctaaacacagtggggggacatcaagcagccatgcaaatgttaaaagagaccatcaatgaggaagctgcagaatgggatagattgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaataaagataggggggcaattaaaggaagctctattagatacaggagcagatgatacagtattagaagaaatgaatttgccaggaagatggaaaccaaaaatgatagggggaattggaggttttatcaaagtaagacagtatgatcagatactcatagaaatctgcggacataaagctataggtacagtattagtaggacctacacctgtcaacataattggaagaaatctgttgactcagattggctgcactttaaattttcccattagtcctattgagactgtaccagtaaaattaaagccaggaatggatggcccaaaagttaaacaatggccattgacagaagaaaaaataaaagcattagtagaaatttgtacagaaatggaaaaggaaggaaaaatttcaaaaattgggcctgaaaatccatacaatactccagtatttgccataaagaaaaaagacagtactaaatggagaaaattagtagatttcagagaacttaataagagaactcaagatttctgggaagttcaattaggaataccacatcctgcagggttaaaacagaaaaaatcagtaacagtactggatgtgggcgatgcatatttttcagttcccttagataaagacttcaggaagtatactgcatttaccatacctagtataaacaatgagacaccagggattagatatcagtacaatgtgcttccacagggatggaaaggatcaccagcaatattccagtgtagcatgacaaaaatcttagagccttttagaaaacaaaatccagacatagtcatctatcaatacatggatgatttgtatgtaggatctgacttagaaatagggcagcatagaacaaaaatagaggaactgagacaacatctgttgaggtggggatttaccacaccagacaaaaaacatcagaaagaacctccattcctttggatgggttatgaactccatcctgataaatggacagtacagcctatagtgctgccagaaaaggacagctggactgtcaatgacatacagaaattagtgggaaaattgaattgggcaagtcagatttatgcagggattaaagtaaggcaattatgtaaacttcttaggggaaccaaagcactaacagaagtagtaccactaacagaagaagcagagctagaactggcagaaaacagggagattctaaaagaaccggtacatggagtgtattatgacccatcaaaagacttaatagcagaaatacagaagcaggggcaaggccaatggacatatcaaatttatcaagagccatttaaaaatctgaaaacaggaaagtatgcaagaatgaacgaatctgccgttgccatatacagcatctgaacaagctgatcgaacccttcatggacggttaaggccgcctgttggtgggcggggatcaagcaggaatttggcattccctacaatccccaaagtcaaggagtaatagaatctatgaataaagaattaaagaaaattataggacaggtaagagatcaggctgaacatcttaagacagcagtacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggaaaggaccagcaaagctcctctggaaaggtgaaggggcagtagtaatacaagataatagtgacataaaagtagtgccaagaagaaaagcaaagatcatcagggattatggaaaacagatggcaggtgatgattgtgtggcccgtccatgaagggttcgattcttgaacagcgcggtctgttatggcaacggcagattcgtttaatgcaacctataatagtagcaatagtagcattagtagtagcaataataatagcaatagttgtgtggtccatagtaatcatagaatataggaaaatattaagacaaagaaaaatagacaggttaattgatagactaatagaaagagcagaagacagtggcaatgagagtgaaggagaagtatcagcacttgtggagatgggggtggaaatggggcaccatgctccttgggatattgatgatctgtagtgctacagaaaaattgtgggtcacagtctattatggggtacctgtgtggaaggaagcaaccaccactctattttgtgcatcagatgctaaagcatatgatacagaggtacataatgtttgggccacacatgcctgtgtacccacagaccccaacccacaagaagtagtattggtaaatgtgacagaaaattttaacatgtggaaaaatgacatggtagaacagatgcatgaggatataatcagtttatgggatcaaagcctaaagccatgtgtaaaattaaccccactctgtgttagtttaaagtgcactgatttgaagaatgatactaataccaatagtagtagcgggagaatgataatggagaaaggagagataaaaaactgctctttcaatatcagcacaagcataagagataaggtgcagaaagaatatgcattcttttataaacttgatatagtaccaatagataataccagctataggttgataagttgtaacacctcagtcattacacaggcctgtccaaaggtatcctttgagccaattcccatacattattgtgccccggctggttttgcgattctaaaatgtaataataagacgttcaatggaacaggaccatgtacaaatgtcagcacagtacaatgtacacatggaatcaggccagtagtatcaactcaactgctgttaaatggcagtctagcagaagaagatgtagtaattagatctgccaatttcacagacaatgctaaaaccataatagtacagctgaacacatctgtagaaattaattgtacaagacccaacaacaatacaagaaaaagtatccgtatccagaggggaccagggagagcatttgttacaataggaaaaataggaaatatgagacaagcacattgtaacattagtagagcaaaatggaatgccactttaaaacagatagctagcaaattaagagaacaatttggaaataataaaacaataatctttaagcaatcctcaggaggggacccagaaattgtaacgcacagttttaattgtggaggggaatttttctactgtaattcaacacaactgtttaatagtacttggtttaatagtacttggagtactgaagggtcaaataacactgaaggaagtgacacaatcacactcccatgcagaataaaacaatttataaacatgtggcaggaagtaggaaaagcaatgtatgcccctcccatcagtggacaaattagatgttcatcaaatattactgggctgctattaacaagagatggtggtaataacaacaatgggtccgagatcttcagacctggaggaggcgatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctgatatagtgcagcagcagaacaatttgctgagggctattgaggcgcaacagcatctgttgcaactcacagtctggggcatcaaacagctccaggcaagaatcctggctgtggaaagatacctaaaggatcaacagctcctggggatttggggttgctctggaaaactcatttgcaccactgctgtgccttggaatgctagttggagtaataaatctctggaacagatttggaataacatgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaatcccgaggggacccgacaggcccgaaggaatagaagaagaaggtggagagagagacagagacagatccattcgattagtgaacggatccttagcacttatctgggacgatctgcggagcctgtgcctcttcagctaccaccgcttgagagacttactcttgattgtaacgaggattgtggaacttctgggacgcagggggtgggaagccctcaaatattggtggaatctcctacagtattggagtcaggaactaaagaatagtgctgttaacttgctcaatgccacagccatagcagtagctgaggggacagatagggttatagaagtattacaagcagcttatagagctattcgccacatacctagaagaataagacagggcttggaaaggattttgctataagatgggtggcaagtggtcaaaaagtagtgtgattggatggcctgctgtaagggaaagaatgagacgagctgagccagcagcagatggggtgggagcagtatctcgagacctagaaaaacatggagcaatcacaagtagcaatacagcagctaacaatgctgcttgtgcctggctagaagcacaagaggaggaagaggtgggttttccagtcacacctcaggtacctttaagaccaatgacttacaaggcagctgtagatcttagccactttttaaaagaaaaggggggactggaagggctaattcactcccaaagaagacaagatatccttaccgtccatgaagggttcgatcgtaaagtgggatagttttttatggcaacggcagattcgttgagcctgcatggaatggatgaccctgagagagaagtgttagagtggaggtttgacagccgcctagcatttcatcacgtggcccgagagctgcatccggagtacttcaagaactgctgacatcgagcttgctacaagggactttccgctggggactttccagggaggcgtggcctgggcgggactggggagtggcgagccctcagatgctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagca

SEQ ID NO: 70 - DNA, 7801 bp, Artificial Sequence
  Synthetic Sequence
tggaagggctaatttggtcccaaaaaagacaagagatccttgatctgtggatctaccacacacaaggctacttccctgattggcagaactacacaccagggccagggatcagatatccactgacctttggatggtgcttcaagttagtaccagttgaaccagagcaagtagaagaggccaatgaaggagagaacaacagcttgttacaccctatgagccagcatgggatggaggacccggagggagaagtattagtgtggaagtttgacagcctcctagcatttcgtcacatggcccgagagctgcatccggagtactacaaagactgctgacatcgagctttctacaagggactttccgctggggactttccagggaggtgtggcctgggcgggactggggagtggcgagccctcagatgctacatataagcagctgctttttgcctgtactgggtctctctggttagaccagatctgagcctgggagctctctggctaactagggaacccactgcttaagcctcaataaagcttgccttgagtgctcaaagtagtgtgtgcccgtctgttgtgtgactctggtaactagagatccctcagacccttttagtcagtgtggaaaatctctagcagtggcgcccgaacagggacttgaaagcgaaagtaaagccagaggagatctctcgacgcaggactcggcttgctgaagcgcgcacggcaagaggcgaggggcggcgactggtgagtacgccaaaaattttgactagcggaggctagaaggagagagatgggtgcgagagcgtcggtattaagcgggggagaattagataaatgggaaaaaattcggttaaggccagggggaaagaaacaatataaactaaaacatatagtatgggcaagcagggagctagaacgattcgcagttaatcctggccttttagagacatcagaaggctgtagacaaatactgggacagctacaaccatcccttcagacaggatcagaagaacttagatcattatataatacaatagcagtcctctattgtgtgcatcaaaggatagatgtaaaagacaccaaggaagccttagataagatagaggaagagcaaaacaaaagtaagaaaaaggcacagcaagcagcagctgacacaggaaacaacagccaggtcagccaaaattaccctatagtgcagaacctccaggggcaaatggtacatcaggccatatcacctagaactttaaatgcatgggtaaaagtagtagaagagaaggctttcagcccagaagtaatacccatgttttcagcattatcagaaggagccaccccacaagatttaaataccatgctaaacacagtggggggacatcaagcagccatgcaaatgttaaaagagaccatcaatgaggaagctgcagaatgggatagattgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaataaagataggggggcaattaaaggaagctctattagatacaggagcagatgatacagtattagaagaaatgaatttgccaggaagatggaaaccaaaaatgatagggggaattggaggttttatcaaagtaagacagtatgatcagatactcatagaaatctgcggacataaagctataggtacagtattagtaggacctacacctgtcaacataattggaagaaatctgttgactcagattggctgcactttaaattttcccattagtcctattgagactgtaccagtaaaattaaagccaggaatggatggcccaaaagttaaacaatggccattgacagaagaaaaaataaaagcattagtagaaatttgtacagaaatggaaaaggaaggaaaaatttcaaaaattgggcctgaaaatccatacaatactccagtatttgccataaagaaaaaagacagtactaaatggagaaaattagtagatttcagagaacttaataagagaactcaagatttctgggaagttcaattaggaataccacatcctgcagggttaaaacagaaaaaatcagtaacagtactggatgtgggcgatgcatatttttcagttcccttagataaagacttcaggaagtatactgcatttaccatacctagtataaacaatgagacaccagggattagatatcagtacaatgtgcttccacagggatggaaaggatcaccagcaatattccagtgtagcatgacaaaaatcttagagccttttagaaaacaaaatccagacatagtcatctatcaatacatggatgatttgtatgtaggatctgacttagaaatagggcagcatagaacaaaaatagaggaactgagacaacatctgttgaggtggggatttaccacaccagacaaaaaacatcagaaagaacctccattcctttggatgggttatgaactccatcctgataaatggacagtacagcctatagtgctgccagaaaaggacagctggactgtcaatgacatacagaaattagtgggaaaattgaattgggcaagtcagatttatgcagggattaaagtaaggcaattatgtaaacttcttaggggaaccaaagcactaacagaagtagtaccactaacagaagaagcagagctagaactggcagaaaacagggagattctaaaagaaccggtacatggagtgtattatgacccatcaaaagacttaatagcagaaatacagaagcaggggcaaggccaatggacatatcaaatttatcaagagccatttaaaaatctgaaaacaggaaagtatgcaagaatgaacgaatctgccgttgccatatacagcatctgaacaagctgatcgaacccttcatggacggttaaggccgcctgttggtgggcggggatcaagcaggaatttggcattccctacaatccccaaagtcaaggagtaatagaatctatgaataaagaattaaagaaaattataggacaggtaagagatcaggctgaacatcttaagacagcagtacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggaaaggaccagcaaagctcctctggaaaggtgaaggggcagtagtaatacaagataatagtgacataaaagtagtgccaagaagaaaagcaaagatcatcagggattatggaaaacagatggcaggtgatgattgtgtggctaatgcaacctataatagtagcaatagtagcattagtagtagcaataataatagcaatagttgtgtggtccatagtaatcatagaatataggaaaatattaagacaaagaaaaatagacaggttaattgatagactaatagaaagagcagaagacagtggcaatgagagtgaaggagaagtatcagcacttgtggagatgggggtggaaatggggcaccatgctccttgggatattgatgatctgtagtgctacagaaaaattgtgggtcacagtctattatggggtacctgtgtggaaggaagcaaccaccactctattttgtgcatcagatgctaaagcatatgatacagaggtacataatgtttgggccacacatgcctgtgtacccacagaccccaacccacaagaagtagtattggtaaatgtgacagaaaattttaacatgtggaaaaatgacatggtagaacagatgcatgaggatataatcagtttatgggatcaaagcctaaagccatgtgtaaaattaaccccactctgtgttagtttaaagtgcactgatttgaagaatgatactaataccaatagtagtagcgggagaatgataatggagaaaggagagataaaaaactgctctttcaatatcagcacaagcataagagataaggtgcagaaagaatatgcattcttttataaacttgatatagtaccaatagataataccagctataggttgataagttgtaacacctcagtcattacacaggcctgtccaaaggtatcctttgagccaattcccatacattattgtgccccggctggttttgcgattctaaaatgtaataataagacgttcaatggaacaggaccatgtacaaatgtcagcacagtacaatgtacacatggaatcaggccagtagtatcaactcaactgctgttaaatggcagtctagcagaagaagatgtagtaattagatctgccaatttcacagacaatgctaaaaccataatagtacagctgaacacatctgtagaaattaattgtacaagacccaacaacaatacaagaaaaagtatccgtatccagaggggaccagggagagcatttgttacaataggaaaaataggaaatatgagacaagcacattgtaacattagtagagcaaaatggaatgccactttaaaacagatagctagcaaattaagagaacaatttggaaataataaaacaataatctttaagcaatcctcaggaggggacccagaaattgtaacgcacagttttaattgtggaggggaatttttctactgtaattcaacacaactgtttaatagtacttggtttaatagtacttggagtactgaagggtcaaataacactgaaggaagtgacacaatcacactcccatgcagaataaaacaatttataaacatgtggcaggaagtaggaaaagcaatgtatgcccctcccatcagtggacaaattagatgttcatcaaatattactgggctgctattaacaagagatggtggtaataacaacaatgggtccgagatcttcagacctggaggaggcgatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctgatatagtgcagcagcagaacaatttgctgagggctattgaggcgcaacagcatctgttgcaactcacagtctggggcatcaaacagctccaggcaagaatcctggctgtggaaagatacctaaaggatcaacagctcctggggatttggggttgctctggaaaactcatttgcaccactgctgtgccttggaatgctagttggagtaataaatctctggaacagatttggaataacatgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaatcccgaggggacccgacaggcccgaaggaatagaagaagaaggtggagagagagacagagacagatccattcgattagtgaacggatccttagcacttatctgggacgatctgcggagcctgtgcctcttcagctaccaccgcttgagagacttactcttgattgtaacgaggattgtggaacttctgggacgcagggggtgggaagccctcaaatattggtggaatctcctacagtattggagtcaggaactaaagaatagtgctgttaacttgctcaatgccacagccatagcagtagctgaggggacagatagggttatagaagtattacaagcagcttatagagctattcgccacatacctagaagaataagacagggcttggaaaggattttgctataagatgggtggcaagtggtcaaaaagtagtgtgattggatggcctgctgtaagggaaagaatgagacgagctgagccagcagcagatggggtgggagcagtatctcgagacctagaaaaacatggagcaatcacaagtagcaatacagcagctaacaatgctgcttgtgcctggctagaagcacaagaggaggaagaggtgggttttccagtcacacctcaggtacctttaagaccaatgacttacaaggcagctgtagatcttagccactttttaaaagaaaaggggggactggaagggctaattcactcccaaagaagacaagatatccttgatctgtggatctaccacacacaaggctacttccctgattggcagaactacacaccagggccaggggtcagatatccactgacctttggatggtgctacaagctagtaccagttgagccagataaggtagaagaggccaataaaggagagaacaccagcttgttacaccctgtgagcctgcatggaatggatgaccctgagagagaagtgttagagtggaggtttgacagccgcctagcatttcatcacgtggcccgagagctgcatccggagtacttcaagaactgctgacatcgagcttgctacaagggactttccgctggggactttccagggaggcgtggcctgggcgggactggggagtggcgagccctcagatgctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagca

SEQ ID NO: 71 - DNA, 7690 bp, Artificial Sequence
  Synthetic Sequence
tggaagggctaatttggtcccaaaaaagacaagagatccttgatctgtggatctaccacacacaaggctacttccctgattggcagaactacacaccagggccagggatcagatatccactgacctttggatggtgcttcaagttagtaccagttgaaccagagcaagtagaagaggccaatgaaggagagaacaacagcttgttacaccctatgagccagcatgggatggaggacccggagggagaagtattagtgtggaagtttgacagcctcctagcatttcgtcacatggcccgagagctgcatccggagtactacaaagactgctgacatcgagctttctacaagggactttccgctggggactttccagggaggtgtggcctgggcgggactggggagtggcgagccctcagatgctacatataagcagctgctttttgcctgtactgggtctctctggttagaccagatctgagcctgggagctctctggctaactagggaacccactgcttaagcctcaataaagcttgccttgagtgctcaaagtagtgtgtgcccgtctgttgtgtgactctggtaactagagatccctcagacccttttagtcagtgtggaaaatctctagcagtggcgcccgaacagggacttgaaagcgaaagtaaagccagaggagatctctcgacgcaggactcggcttgctgaagcgcgcacggcaagaggcgaggggcggcgactggtgagtacgccaaaaattttgactagcggaggctagaaggagagagatgggtgcgagagcgtcggtattaagcgggggagaattagataaatgggaaaaaattcggttaaggccagggggaaagaaacaatataaactaaaacatatagtatgggcaagcagggagctagaacgattcgcagttaatcctggccttttagagacatcagaaggctgtagacaaatactgggacagctacaaccatcccttcagacaggatcagaagaacttagatcattatataatacaatagcagtcctctattgtgtgcatcaaaggatagatgtaaaagacaccaaggaagccttagataagatagaggaagagcaaaacaaaagtaagaaaaaggcacagcaagcagcagctgacacaggaaacaacagccaggtcagccaaaattaccctatagtgcagaacctccaggggcaaatggtacatcaggccatatcacctagaactttaaatgcatgggtaaaagtagtagaagagaaggctttcagcccagaagtaatacccatgttttcagcattatcagaaggagccaccccacaagatttaaataccatgctaaacacagtggggggacatcaagcagccatgcaaatgttaaaagagaccatcaatgaggaagctgcagaatgggatagattgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaataaagataggggggcaattaaaggaagctctattagatacaggagcagatgatacagtattagaagaaatgaatttgccaggaagatggaaaccaaaaatgatagggggaattggaggttttatcaaagtaagacagtatgatcagatactcatagaaatctgcggacataaagctataggtacagtattagtaggacctacacctgtcaacataattggaagaaatctgttgactcagattggctgcactttaaattttcccattagtcctattgagactgtaccagtaaaattaaagccaggaatggatggcccaaaagttaaacaatggccattgacagaagaaaaaataaaagcattagtagaaatttgtacagaaatggaaaaggaaggaaaaatttcaaaaattgggcctgaaaatccatacaatactccagtatttgccataaagaaaaaagacagtactaaatggagaaaattagtagatttcagagaacttaataagagaactcaagatttctgggaagttcaattaggaataccacatcctgcagggttaaaacagaaaaaatcagtaacagtactggatgtgggcgatgcatatttttcagttcccttagataaagacttcaggaagtatactgcatttaccatacctagtataaacaatgagacaccagggattagatatcagtacaatgtgcttccacagggatggaaaggatcaccagcaatattccagtgtagcatgacaaaaatcttagagccttttagaaaacaaaatccagacatagtcatctatcaatacatggatgatttgtatgtaggatctgacttagaaatagggcagcatagaacaaaaatagaggaactgagacaacatctgttgaggtggggatttaccacaccagacaaaaaacatcagaaagaacctccattcctttggatgggttatgaactccatcctgataaatggacagtacagcctatagtgctgccagaaaaggacagctggactgtcaatgacatacagaaattagtgggaaaattgaattgggcaagtcagatttatgcagggattaaagtaaggcaattatgtaaacttcttaggggaaccaaagcactaacagaagtagtaccactaacagaagaagcagagctagaactggcagaaaacagggagattctaaaagaaccggtacatggagtgtattatgacccatcaaaagacttaatagcagaaatacagaagcaggggcaaggccaatggacatatcaaatttatcaagagccatttaaaaatctgaaaacaggaaagtatgcaagaatgaacgaatctgccgttgccatatacagcatctgaacaagctgatcgaacccttcatggacggttaaggccgcctgttggtgggcggggatcaagcaggaatttggcattccctacaatccccaaagtcaaggagtaatagaatctatgaataaagaattaaagaaaattataggacaggtaagagatcaggctgaacatcttaagacagcagtacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggaaaggaccagcaaagctcctctggaaaggtgaaggggcagtagtaatacaagataatagtgacataaaagtagtgccaagaagaaaagcaaagatcatcagggattatggaaaacagatggcaggtgatgattgtgtggctaatgcaacctataatagtagcaatagtagcattagtagtagcaataataatagcaatagttgtgtggtccatagtaatcatagaatataggaaaatattaagacaaagaaaaatagacaggttaattgatagactaatagaaagagcagaagacagtggcaatgagagtgaaggagaagtatcagcacttgtggagatgggggtggaaatggggcaccatgctccttgggatattgatgatctgtagtgctacagaaaaattgtgggtcacagtctattatggggtacctgtgtggaaggaagcaaccaccactctattttgtgcatcagatgctaaagcatatgatacagaggtacataatgtttgggccacacatgcctgtgtacccacagaccccaacccacaagaagtagtattggtaaatgtgacagaaaattttaacatgtggaaaaatgacatggtagaacagatgcatgaggatataatcagtttatgggatcaaagcctaaagccatgtgtaaaattaaccccactctgtgttagtttaaagtgcactgatttgaagaatgatactaataccaatagtagtagcgggagaatgataatggagaaaggagagataaaaaactgctctttcaatatcagcacaagcataagagataaggtgcagaaagaatatgcattcttttataaacttgatatagtaccaatagataataccagctataggttgataagttgtaacacctcagtcattacacaggcctgtccaaaggtatcctttgagccaattcccatacattattgtgccccggctggttttgcgattctaaaatgtaataataagacgttcaatggaacaggaccatgtacaaatgtcagcacagtacaatgtacacatggaatcaggccagtagtatcaactcaactgctgttaaatggcagtctagcagaagaagatgtagtaattagatctgccaatttcacagacaatgctaaaaccataatagtacagctgaacacatctgtagaaattaattgtacaagacccaacaacaatacaagaaaaagtatccgtatccagaggggaccagggagagcatttgttacaataggaaaaataggaaatatgagacaagcacattgtaacattagtagagcaaaatggaatgccactttaaaacagatagctagcaaattaagagaacaatttggaaataataaaacaataatctttaagcaatcctcaggaggggacccagaaattgtaacgcacagttttaattgtggaggggaatttttctactgtaattcaacacaactgtttaatagtacttggtttaatagtacttggagtactgaagggtcaaataacactgaaggaagtgacacaatcacactcccatgcagaataaaacaatttataaacatgtggcaggaagtaggaaaagcaatgtatgcccctcccatcagtggacaaattagatgttcatcaaatattactgggctgctattaacaagagatggtggtaataacaacaatgggtccgagatcttcagacctggaggaggcgatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctgatatagtgcagcagcagaacaatttgctgagggctattgaggcgcaacagcatctgttgcaactcacagtctggggcatcaaacagctccaggcaagaatcctggctgtggaaagatacctaaaggatcaacagctcctggggatttggggttgctctggaaaactcatttgcaccactgctgtgccttggaatgctagttggagtaataaatctctggaacagatttggaataacatgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaatcccgaggggacccgacaggcccgaaggaatagaagaagaaggtggagagagagacagagacagatccattcgattagtgaacggatccttagcacttatctgggacgatctgcggagcctgtgcctcttcagctaccaccgcttgagagacttactcttgattgtaacgaggattgtggaacttctgggacgcagggggtgggaagccctcaaatattggtggaatctcctacagtattggagtcaggaactaaagaatagtgctgttaacttgctcaatgccacagccatagcagtagctgaggggacagatagggttatagaagtattacaagcagcttatagagctattcgccacatacctagaagaataagacagggcttggaaaggattttgctataagatgggtggcaagtggtcaaaaagtagtgtgattggatggcctgctgtaagggaaagaatgagacgagctgagccagcagcagatggggtgggagcagtatctcgagacctagaaaaacatggagcaatcacaagtagcaatacagcagctaacaatgctgcttgtgcctggctagaagcacaagaggaggaagaggtgggttttccagtcacacctcaggtacctttaagaccaatgacttacaaggcagctgtagatcttagccactttttaaaagaaaaggggggactggaagggctaattcactcccaaagaagacaagatatccttaccgtccatgaagggttcgatcgtaaagtgggatagttttttatggcaacggcagattcgttgagcctgcatggaatggatgaccctgagagagaagtgttagagtggaggtttgacagccgcctagcatttcatcacgtggcccgagagctgcatccggagtacttcaagaactgctgacatcgagcttgctacaagggactttccgctggggactttccagggaggcgtggcctgggcgggactggggagtggcgagccctcagatgctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagca

SEQ ID NO: 72 - DNA, 7759 bp, Artificial Sequence
  Synthetic Sequence
tggaagggctaatttggtcccaaaaaagacaagagatccttgatctgtggatctaccacacacaaggctacttccctgattggcagaactacacaccagggccagggatcagatatccactgacctttggatggtgcttcaagttagtaccagttgaaccagagcaagtagaagaggccaatgaaggagagaacaacagcttgttacaccctatgagccagcatgggatggaggacccggagggagaagtattagtgtggaagtttgacagcctcctagcatttcgtcacatggcccgagagctgcatccggagtactacaaagactgctgacatcgagctttctacaagggactttccgctggggactttccagggaggtgtggcctgggcgggactggggagtggcgagccctcagatgctacatataagcagctgctttttgcctgtactgggtctctctggttagaccagatctgagcctgggagctctctggctaactagggaacccactgcttaagcctcaataaagcttgccttgagtgctcaaagtagtgtgtgcccgtctgttgtgtgactctggtaactagagatccctcagacccttttagtcagtgtggaaaatctctagcagtggcgcccgaacagggacttgaaagcgaaagtaaagccagaggagatctctcgacgcaggactcggcttgctgaagcgcgcacggcaagaggcgaggggcggcgactggtgagtacgccaaaaattttgactagcggaggctagaaggagagagatgggtgcgagagcgtcggtattaagcgggggagaattagataaatgggaaaaaattcggttaaggccagggggaaagaaacaatataaactaaaacatatagtatgggcaagcagggagctagaacgattcgcagttaatcctggccttttagagacatcagaaggctgtagacaaatactgggacagctacaaccatcccttcagacaggatcagaagaacttagatcattatataatacaatagcagtcctctattgtgtgcatcaaaggatagatgtaaaagacaccaaggaagccttagataagatagaggaagagcaaaacaaaagtaagaaaaaggcacagcaagcagcagctgacacaggaaacaacagccaggtcagccaaaattaccctatagtgcagaacctccaggggcaaatggtacatcaggccatatcacctagaactttaaatgcatgggtaaaagtagtagaagagaaggctttcagcccagaagtaatacccatgttttcagcattatcagaaggagccaccccacaagatttaaataccatgctaaacacagtggggggacatcaagcagccatgcaaatgttaaaagagaccatcaatgaggaagctgcagaatgggatagattgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaataaagataggggggcaattaaaggaagctctattagatacaggagcagatgatacagtattagaagaaatgaatttgccaggaagatggaaaccaaaaatgatagggggaattggaggttttatcaaagtaagacagtatgatcagatactcatagaaatctgcggacataaagctataggtacagtattagtaggacctacacctgtcaacataattggaagaaatctgttgactcagattggctgcactttaaattttcccattagtcctattgagactgtaccagtaaaattaaagccaggaatggatggcccaaaagttaaacaatggccattgacagaagaaaaaataaaagcattagtagaaatttgtacagaaatggaaaaggaaggaaaaatttcaaaaattgggcctgaaaatccatacaatactccagtatttgccataaagaaaaaagacagtactaaatggagaaaattagtagatttcagagaacttaataagagaactcaagatttctgggaagttcaattaggaataccacatcctgcagggttaaaacagaaaaaatcagtaacagtactggatgtgggcgatgcatatttttcagttcccttagataaagacttcaggaagtatactgcatttaccatacctagtataaacaatgagacaccagggattagatatcagtacaatgtgcttccacagggatggaaaggatcaccagcaatattccagtgtagcatgacaaaaatcttagagccttttagaaaacaaaatccagacatagtcatctatcaatacatggatgatttgtatgtaggatctgacttagaaatagggcagcatagaacaaaaatagaggaactgagacaacatctgttgaggtggggatttaccacaccagacaaaaaacatcagaaagaacctccattcctttggatgggttatgaactccatcctgataaatggacagtacagcctatagtgctgccagaaaaggacagctggactgtcaatgacatacagaaattagtgggaaaattgaattgggcaagtcagatttatgcagggattaaagtaaggcaattatgtaaacttcttaggggaaccaaagcactaacagaagtagtaccactaacagaagaagcagagctagaactggcagaaaacagggagattctaaaagaaccggtacatggagtgtattatgacccatcaaaagacttaatagcagaaatacagaagcaggggcaaggccaatggacatatcaaatttatcaagagccatttaaaaatctgaaaacaggaaagtatgcaagaatgaacgaatctgccgttgccatatacagcatctgaacaagctgatcgaacccttcatggacggttaaggccgcctgttggtgggcggggatcaagcaggaatttggcattccctacaatccccaaagtcaaggagtaatagaatctatgaataaagaattaaagaaaattataggacaggtaagagatcaggctgaacatcttaagacagcagtacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggaaaggaccagcaaagctcctctggaaaggtgaaggggcagtagtaatacaagataatagtgacataaaagtagtgccaagaagaaaagcaaagatcatcagggattatggaaaacagatggcaggtgatgattgtgtaccgtccatgaagggttcgatgatcggtcgtcgcagcggtctatggcaacggcagattcgttagacaaagaaaaatagacaggttaattgatagactaatagaaagagcagaagacagtggcaatgagagtgaaggagaagtatcagcacttgtggagatgggggtggaaatggggcaccatgctccttgggatattgatgatctgtagtgctacagaaaaattgtgggtcacagtctattatggggtacctgtgtggaaggaagcaaccaccactctattttgtgcatcagatgctaaagcatatgatacagaggtacataatgtttgggccacacatgcctgtgtacccacagaccccaacccacaagaagtagtattggtaaatgtgacagaaaattttaacatgtggaaaaatgacatggtagaacagatgcatgaggatataatcagtttatgggatcaaagcctaaagccatgtgtaaaattaaccccactctgtgttagtttaaagtgcactgatttgaagaatgatactaataccaatagtagtagcgggagaatgataatggagaaaggagagataaaaaactgctctttcaatatcagcacaagcataagagataaggtgcagaaagaatatgcattcttttataaacttgatatagtaccaatagataataccagctataggttgataagttgtaacacctcagtcattacacaggcctgtccaaaggtatcctttgagccaattcccatacattattgtgccccggctggttttgcgattctaaaatgtaataataagacgttcaatggaacaggaccatgtacaaatgtcagcacagtacaatgtacacatggaatcaggccagtagtatcaactcaactgctgttaaatggcagtctagcagaagaagatgtagtaattagatctgccaatttcacagacaatgctaaaaccataatagtacagctgaacacatctgtagaaattaattgtacaagacccaacaacaatacaagaaaaagtatccgtatccagaggggaccagggagagcatttgttacaataggaaaaataggaaatatgagacaagcacattgtaacattagtagagcaaaatggaatgccactttaaaacagatagctagcaaattaagagaacaatttggaaataataaaacaataatctttaagcaatcctcaggaggggacccagaaattgtaacgcacagttttaattgtggaggggaatttttctactgtaattcaacacaactgtttaatagtacttggtttaatagtacttggagtactgaagggtcaaataacactgaaggaagtgacacaatcacactcccatgcagaataaaacaatttataaacatgtggcaggaagtaggaaaagcaatgtatgcccctcccatcagtggacaaattagatgttcatcaaatattactgggctgctattaacaagagatggtggtaataacaacaatgggtccgagatcttcagacctggaggaggcgatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctgatatagtgcagcagcagaacaatttgctgagggctattgaggcgcaacagcatctgttgcaactcacagtctggggcatcaaacagctccaggcaagaatcctggctgtggaaagatacctaaaggatcaacagctcctggggatttggggttgctctggaaaactcatttgcaccactgctgtgccttggaatgctagttggagtaataaatctctggaacagatttggaataacatgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaatcccgaggggacccgacaggcccgaaggaatagaagaagaaggtggagagagagacagagacagatccattcgattagtgaacggatccttagcacttatctgggacgatctgcggagcctgtgcctcttcagctaccaccgcttgagagacttactcttgattgtaacgaggattgtggaacttctgggacgcagggggtgggaagccctcaaatattggtggaatctcctacagtattggagtcaggaactaaagaatagtgctgttaacttgctcaatgccacagccatagcagtagctgaggggacagatagggttatagaagtattacaagcagcttatagagctattcgccacatacctagaagaataagacagggcttggaaaggattttgctataagatgggtggcaagtggtcaaaaagtagtgtgattggatggcctgctgtaagggaaagaatgagacgagctgagccagcagcagatggggtgggagcagtatctcgagacctagaaaaacatggagcaatcacaagtagcaatacagcagctaacaatgctgcttgtgcctggctagaagcacaagaggaggaagaggtgggttttccagtcacacctcaggtacctttaagaccaatgacttacaaggcagctgtagatcttagccactttttaaaagaaaaggggggactggaagggctaattcactcccaaagaagacaagatatccttgatctgtggatctaccacacacaaggctacttccctgattggcagaactacacaccagggccaggggtcagatatccactgacctttggatggtgctacaagctagtaccagttgagccagataaggtagaagaggccaataaaggagagaacaccagcttgttacaccctgtgagcctgcatggaatggatgaccctgagagagaagtgttagagtggaggtttgacagccgcctagcatttcatcacgtggcccgagagctgcatccggagtacttcaagaactgctgacatcgagcttgctacaagggactttccgctggggactttccagggaggcgtggcctgggcgggactggggagtggcgagccctcagatgctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagca

SEQ ID NO: 73 - DNA, 7648 bp, Artificial Sequence
  Synthetic Sequence
tggaagggctaatttggtcccaaaaaagacaagagatccttgatctgtggatctaccacacacaaggctacttccctgattggcagaactacacaccagggccagggatcagatatccactgacctttggatggtgcttcaagttagtaccagttgaaccagagcaagtagaagaggccaatgaaggagagaacaacagcttgttacaccctatgagccagcatgggatggaggacccggagggagaagtattagtgtggaagtttgacagcctcctagcatttcgtcacatggcccgagagctgcatccggagtactacaaagactgctgacatcgagctttctacaagggactttccgctggggactttccagggaggtgtggcctgggcgggactggggagtggcgagccctcagatgctacatataagcagctgctttttgcctgtactgggtctctctggttagaccagatctgagcctgggagctctctggctaactagggaacccactgcttaagcctcaataaagcttgccttgagtgctcaaagtagtgtgtgcccgtctgttgtgtgactctggtaactagagatccctcagacccttttagtcagtgtggaaaatctctagcagtggcgcccgaacagggacttgaaagcgaaagtaaagccagaggagatctctcgacgcaggactcggcttgctgaagcgcgcacggcaagaggcgaggggcggcgactggtgagtacgccaaaaattttgactagcggaggctagaaggagagagatgggtgcgagagcgtcggtattaagcgggggagaattagataaatgggaaaaaattcggttaaggccagggggaaagaaacaatataaactaaaacatatagtatgggcaagcagggagctagaacgattcgcagttaatcctggccttttagagacatcagaaggctgtagacaaatactgggacagctacaaccatcccttcagacaggatcagaagaacttagatcattatataatacaatagcagtcctctattgtgtgcatcaaaggatagatgtaaaagacaccaaggaagccttagataagatagaggaagagcaaaacaaaagtaagaaaaaggcacagcaagcagcagctgacacaggaaacaacagccaggtcagccaaaattaccctatagtgcagaacctccaggggcaaatggtacatcaggccatatcacctagaactttaaatgcatgggtaaaagtagtagaagagaaggctttcagcccagaagtaatacccatgttttcagcattatcagaaggagccaccccacaagatttaaataccatgctaaacacagtggggggacatcaagcagccatgcaaatgttaaaagagaccatcaatgaggaagctgcagaatgggatagattgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaataaagataggggggcaattaaaggaagctctattagatacaggagcagatgatacagtattagaagaaatgaatttgccaggaagatggaaaccaaaaatgatagggggaattggaggttttatcaaagtaagacagtatgatcagatactcatagaaatctgcggacataaagctataggtacagtattagtaggacctacacctgtcaacataattggaagaaatctgttgactcagattggctgcactttaaattttcccattagtcctattgagactgtaccagtaaaattaaagccaggaatggatggcccaaaagttaaacaatggccattgacagaagaaaaaataaaagcattagtagaaatttgtacagaaatggaaaaggaaggaaaaatttcaaaaattgggcctgaaaatccatacaatactccagtatttgccataaagaaaaaagacagtactaaatggagaaaattagtagatttcagagaacttaataagagaactcaagatttctgggaagttcaattaggaataccacatcctgcagggttaaaacagaaaaaatcagtaacagtactggatgtgggcgatgcatatttttcagttcccttagataaagacttcaggaagtatactgcatttaccatacctagtataaacaatgagacaccagggattagatatcagtacaatgtgcttccacagggatggaaaggatcaccagcaatattccagtgtagcatgacaaaaatcttagagccttttagaaaacaaaatccagacatagtcatctatcaatacatggatgatttgtatgtaggatctgacttagaaatagggcagcatagaacaaaaatagaggaactgagacaacatctgttgaggtggggatttaccacaccagacaaaaaacatcagaaagaacctccattcctttggatgggttatgaactccatcctgataaatggacagtacagcctatagtgctgccagaaaaggacagctggactgtcaatgacatacagaaattagtgggaaaattgaattgggcaagtcagatttatgcagggattaaagtaaggcaattatgtaaacttcttaggggaaccaaagcactaacagaagtagtaccactaacagaagaagcagagctagaactggcagaaaacagggagattctaaaagaaccggtacatggagtgtattatgacccatcaaaagacttaatagcagaaatacagaagcaggggcaaggccaatggacatatcaaatttatcaagagccatttaaaaatctgaaaacaggaaagtatgcaagaatgaacgaatctgccgttgccatatacagcatctgaacaagctgatcgaacccttcatggacggttaaggccgcctgttggtgggcggggatcaagcaggaatttggcattccctacaatccccaaagtcaaggagtaatagaatctatgaataaagaattaaagaaaattataggacaggtaagagatcaggctgaacatcttaagacagcagtacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggaaaggaccagcaaagctcctctggaaaggtgaaggggcagtagtaatacaagataatagtgacataaaagtagtgccaagaagaaaagcaaagatcatcagggattatggaaaacagatggcaggtgatgattgtgtaccgtccatgaagggttcgatgatcggtcgtcgcagcggtctatggcaacggcagattcgttagacaaagaaaaatagacaggttaattgatagactaatagaaagagcagaagacagtggcaatgagagtgaaggagaagtatcagcacttgtggagatgggggtggaaatggggcaccatgctccttgggatattgatgatctgtagtgctacagaaaaattgtgggtcacagtctattatggggtacctgtgtggaaggaagcaaccaccactctattttgtgcatcagatgctaaagcatatgatacagaggtacataatgtttgggccacacatgcctgtgtacccacagaccccaacccacaagaagtagtattggtaaatgtgacagaaaattttaacatgtggaaaaatgacatggtagaacagatgcatgaggatataatcagtttatgggatcaaagcctaaagccatgtgtaaaattaaccccactctgtgttagtttaaagtgcactgatttgaagaatgatactaataccaatagtagtagcgggagaatgataatggagaaaggagagataaaaaactgctctttcaatatcagcacaagcataagagataaggtgcagaaagaatatgcattcttttataaacttgatatagtaccaatagataataccagctataggttgataagttgtaacacctcagtcattacacaggcctgtccaaaggtatcctttgagccaattcccatacattattgtgccccggctggttttgcgattctaaaatgtaataataagacgttcaatggaacaggaccatgtacaaatgtcagcacagtacaatgtacacatggaatcaggccagtagtatcaactcaactgctgttaaatggcagtctagcagaagaagatgtagtaattagatctgccaatttcacagacaatgctaaaaccataatagtacagctgaacacatctgtagaaattaattgtacaagacccaacaacaatacaagaaaaagtatccgtatccagaggggaccagggagagcatttgttacaataggaaaaataggaaatatgagacaagcacattgtaacattagtagagcaaaatggaatgccactttaaaacagatagctagcaaattaagagaacaatttggaaataataaaacaataatctttaagcaatcctcaggaggggacccagaaattgtaacgcacagttttaattgtggaggggaatttttctactgtaattcaacacaactgtttaatagtacttggtttaatagtacttggagtactgaagggtcaaataacactgaaggaagtgacacaatcacactcccatgcagaataaaacaatttataaacatgtggcaggaagtaggaaaagcaatgtatgcccctcccatcagtggacaaattagatgttcatcaaatattactgggctgctattaacaagagatggtggtaataacaacaatgggtccgagatcttcagacctggaggaggcgatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctgatatagtgcagcagcagaacaatttgctgagggctattgaggcgcaacagcatctgttgcaactcacagtctggggcatcaaacagctccaggcaagaatcctggctgtggaaagatacctaaaggatcaacagctcctggggatttggggttgctctggaaaactcatttgcaccactgctgtgccttggaatgctagttggagtaataaatctctggaacagatttggaataacatgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaatcccgaggggacccgacaggcccgaaggaatagaagaagaaggtggagagagagacagagacagatccattcgattagtgaacggatccttagcacttatctgggacgatctgcggagcctgtgcctcttcagctaccaccgcttgagagacttactcttgattgtaacgaggattgtggaacttctgggacgcagggggtgggaagccctcaaatattggtggaatctcctacagtattggagtcaggaactaaagaatagtgctgttaacttgctcaatgccacagccatagcagtagctgaggggacagatagggttatagaagtattacaagcagcttatagagctattcgccacatacctagaagaataagacagggcttggaaaggattttgctataagatgggtggcaagtggtcaaaaagtagtgtgattggatggcctgctgtaagggaaagaatgagacgagctgagccagcagcagatggggtgggagcagtatctcgagacctagaaaaacatggagcaatcacaagtagcaatacagcagctaacaatgctgcttgtgcctggctagaagcacaagaggaggaagaggtgggttttccagtcacacctcaggtacctttaagaccaatgacttacaaggcagctgtagatcttagccactttttaaaagaaaaggggggactggaagggctaattcactcccaaagaagacaagatatccttaccgtccatgaagggttcgatcgtaaagtgggatagttttttatggcaacggcagattcgttgagcctgcatggaatggatgaccctgagagagaagtgttagagtggaggtttgacagccgcctagcatttcatcacgtggcccgagagctgcatccggagtacttcaagaactgctgacatcgagcttgctacaagggactttccgctggggactttccagggaggcgtggcctgggcgggactggggagtggcgagccctcagatgctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagca

SEQ ID NO: 74 - DNA, 7637 bp, Artificial Sequence
  Synthetic Sequence
tggaagggctaatttggtcccaaaaaagacaagagatccttgatctgtggatctaccacacacaaggctacttccctgattggcagaactacacaccagggccagggatcagatatccactgacctttggatggtgcttcaagttagtaccagttgaaccagagcaagtagaagaggccaatgaaggagagaacaacagcttgttacaccctatgagccagcatgggatggaggacccggagggagaagtattagtgtggaagtttgacagcctcctagcatttcgtcacatggcccgagagctgcatccggagtactacaaagactgctgacatcgagctttctacaagggactttccgctggggactttccagggaggtgtggcctgggcgggactggggagtggcgagccctcagatgctacatataagcagctgctttttgcctgtactgggtctctctggttagaccagatctgagcctgggagctctctggctaactagggaacccactgcttaagcctcaataaagcttgccttgagtgctcaaagtagtgtgtgcccgtctgttgtgtgactctggtaactagagatccctcagacccttttagtcagtgtggaaaatctctagcagtggcgcccgaacagggacttgaaagcgaaagtaaagccagaggagatctctcgacgcaggactcggcttgctgaagcgcgcacggcaagaggcgaggggcggcgactggtgagtacgccaaaaattttgactagcggaggctagaaggagagagatgggtgcgagagcgtcggtattaagcgggggagaattagataaatgggaaaaaattcggttaaggccagggggaaagaaacaatataaactaaaacatatagtatgggcaagcagggagctagaacgattcgcagttaatcctggccttttagagacatcagaaggctgtagacaaatactgggacagctacaaccatcccttcagacaggatcagaagaacttagatcattatataatacaatagcagtcctctattgtgtgcatcaaaggatagatgtaaaagacaccaaggaagccttagataagatagaggaagagcaaaacaaaagtaagaaaaaggcacagcaagcagcagctgacacaggaaacaacagccaggtcagccaaaattaccctatagtgcagaacctccaggggcaaatggtacatcaggccatatcacctagaactttaaatgcatgggtaaaagtagtagaagagaaggctttcagcccagaagtaatacccatgttttcagcattatcagaaggagccaccccacaagatttaaataccatgctaaacacagtggggggacatcaagcagccatgcaaatgttaaaagagaccatcaatgaggaagctgcagaatgggatagattgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaataaagataggggggcaattaaaggaagctctattagatacaggagcagatgatacagtattagaagaaatgaatttgccaggaagatggaaaccaaaaatgatagggggaattggaggttttatcaaagtaagacagtatgatcagatactcatagaaatctgcggacataaagctataggtacagtattagtaggacctacacctgtcaacataattggaagaaatctgttgactcagattggctgcactttaaattttcccattagtcctattgagactgtaccagtaaaattaaagccaggaatggatggcccaaaagttaaacaatggccattgacagaagaaaaaataaaagcattagtagaaatttgtacagaaatggaaaaggaaggaaaaatttcaaaaattgggcctgaaaatccatacaatactccagtatttgccataaagaaaaaagacagtactaaatggagaaaattagtagatttcagagaacttaataagagaactcaagatttctgggaagttcaattaggaataccacatcctgcagggttaaaacagaaaaaatcagtaacagtactggatgtgggcgatgcatatttttcagttcccttagataaagacttcaggaagtatactgcatttaccatacctagtataaacaatgagacaccagggattagatatcagtacaatgtgcttccacagggatggaaaggatcaccagcaatattccagtgtagcatgacaaaaatcttagagccttttagaaaacaaaatccagacatagtcatctatcaatacatggatgatttgtatgtaggatctgacttagaaatagggcagcatagaacaaaaatagaggaactgagacaacatctgttgaggtggggatttaccacaccagacaaaaaacatcagaaagaacctccattcctttggatgggttatgaactccatcctgataaatggacagtacagcctatagtgctgccagaaaaggacagctggactgtcaatgacatacagaaattagtgggaaaattgaattgggcaagtcagatttatgcagggattaaagtaaggcaattatgtaaacttcttaggggaaccaaagcactaacagaagtagtaccactaacagaagaagcagagctagaactggcagaaaacagggagattctaaaagaaccggtacatggagtgtattatgacccatcaaaagacttaatagcagaaatacagaagcaggggcaaggccaatggacatatcaaatttatcaagagccatttaaaaatctgaaaacaggaaagtatgcaagaatgaacgaatctgccgttgccatatacagcatctgaacaagctgatcgaacccttcatggacggttaaggccgcctgttggtgggcggggatcaagcaggaatttggcattccctacaatccccaaagtcaaggagtaatagaatctatgaataaagaattaaagaaaattataggacaggtaagagatcaggctgaacatcttaagacagcagtacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggaaaggaccagcaaagctcctctggaaaggtgaaggggcagtagtaatacaagataatagtgacataaaagtagtgccaagaagaaaagcaaagatcatcagggattaaccgtccatgaagggttcgattatctgtagccaacattcgatatggcaacggcagattcgttggagatgggggtggaaatggggcaccatgctccttgggatattgatgatctgtagtgctacagaaaaattgtgggtcacagtctattatggggtacctgtgtggaaggaagcaaccaccactctattttgtgcatcagatgctaaagcatatgatacagaggtacataatgtttgggccacacatgcctgtgtacccacagaccccaacccacaagaagtagtattggtaaatgtgacagaaaattttaacatgtggaaaaatgacatggtagaacagatgcatgaggatataatcagtttatgggatcaaagcctaaagccatgtgtaaaattaaccccactctgtgttagtttaaagtgcactgatttgaagaatgatactaataccaatagtagtagcgggagaatgataatggagaaaggagagataaaaaactgctctttcaatatcagcacaagcataagagataaggtgcagaaagaatatgcattcttttataaacttgatatagtaccaatagataataccagctataggttgataagttgtaacacctcagtcattacacaggcctgtccaaaggtatcctttgagccaattcccatacattattgtgccccggctggttttgcgattctaaaatgtaataataagacgttcaatggaacaggaccatgtacaaatgtcagcacagtacaatgtacacatggaatcaggccagtagtatcaactcaactgctgttaaatggcagtctagcagaagaagatgtagtaattagatctgccaatttcacagacaatgctaaaaccataatagtacagctgaacacatctgtagaaattaattgtacaagacccaacaacaatacaagaaaaagtatccgtatccagaggggaccagggagagcatttgttacaataggaaaaataggaaatatgagacaagcacattgtaacattagtagagcaaaatggaatgccactttaaaacagatagctagcaaattaagagaacaatttggaaataataaaacaataatctttaagcaatcctcaggaggggacccagaaattgtaacgcacagttttaattgtggaggggaatttttctactgtaattcaacacaactgtttaatagtacttggtttaatagtacttggagtactgaagggtcaaataacactgaaggaagtgacacaatcacactcccatgcagaataaaacaatttataaacatgtggcaggaagtaggaaaagcaatgtatgcccctcccatcagtggacaaattagatgttcatcaaatattactgggctgctattaacaagagatggtggtaataacaacaatgggtccgagatcttcagacctggaggaggcgatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctgatatagtgcagcagcagaacaatttgctgagggctattgaggcgcaacagcatctgttgcaactcacagtctggggcatcaaacagctccaggcaagaatcctggctgtggaaagatacctaaaggatcaacagctcctggggatttggggttgctctggaaaactcatttgcaccactgctgtgccttggaatgctagttggagtaataaatctctggaacagatttggaataacatgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaatcccgaggggacccgacaggcccgaaggaatagaagaagaaggtggagagagagacagagacagatccattcgattagtgaacggatccttagcacttatctgggacgatctgcggagcctgtgcctcttcagctaccaccgcttgagagacttactcttgattgtaacgaggattgtggaacttctgggacgcagggggtgggaagccctcaaatattggtggaatctcctacagtattggagtcaggaactaaagaatagtgctgttaacttgctcaatgccacagccatagcagtagctgaggggacagatagggttatagaagtattacaagcagcttatagagctattcgccacatacctagaagaataagacagggcttggaaaggattttgctataagatgggtggcaagtggtcaaaaagtagtgtgattggatggcctgctgtaagggaaagaatgagacgagctgagccagcagcagatggggtgggagcagtatctcgagacctagaaaaacatggagcaatcacaagtagcaatacagcagctaacaatgctgcttgtgcctggctagaagcacaagaggaggaagaggtgggttttccagtcacacctcaggtacctttaagaccaatgacttacaaggcagctgtagatcttagccactttttaaaagaaaaggggggactggaagggctaattcactcccaaagaagacaagatatccttgatctgtggatctaccacacacaaggctacttccctgattggcagaactacacaccagggccaggggtcagatatccactgacctttggatggtgctacaagctagtaccagttgagccagataaggtagaagaggccaataaaggagagaacaccagcttgttacaccctgtgagcctgcatggaatggatgaccctgagagagaagtgttagagtggaggtttgacagccgcctagcatttcatcacgtggcccgagagctgcatccggagtacttcaagaactgctgacatcgagcttgctacaagggactttccgctggggactttccagggaggcgtggcctgggcgggactggggagtggcgagccctcagatgctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagca

SEQ ID NO: 75 - DNA, 7526 bp, Artificial Sequence
  Synthetic Sequence
tggaagggctaatttggtcccaaaaaagacaagagatccttgatctgtggatctaccacacacaaggctacttccctgattggcagaactacacaccagggccagggatcagatatccactgacctttggatggtgcttcaagttagtaccagttgaaccagagcaagtagaagaggccaatgaaggagagaacaacagcttgttacaccctatgagccagcatgggatggaggacccggagggagaagtattagtgtggaagtttgacagcctcctagcatttcgtcacatggcccgagagctgcatccggagtactacaaagactgctgacatcgagctttctacaagggactttccgctggggactttccagggaggtgtggcctgggcgggactggggagtggcgagccctcagatgctacatataagcagctgctttttgcctgtactgggtctctctggttagaccagatctgagcctgggagctctctggctaactagggaacccactgcttaagcctcaataaagcttgccttgagtgctcaaagtagtgtgtgcccgtctgttgtgtgactctggtaactagagatccctcagacccttttagtcagtgtggaaaatctctagcagtggcgcccgaacagggacttgaaagcgaaagtaaagccagaggagatctctcgacgcaggactcggcttgctgaagcgcgcacggcaagaggcgaggggcggcgactggtgagtacgccaaaaattttgactagcggaggctagaaggagagagatgggtgcgagagcgtcggtattaagcgggggagaattagataaatgggaaaaaattcggttaaggccagggggaaagaaacaatataaactaaaacatatagtatgggcaagcagggagctagaacgattcgcagttaatcctggccttttagagacatcagaaggctgtagacaaatactgggacagctacaaccatcccttcagacaggatcagaagaacttagatcattatataatacaatagcagtcctctattgtgtgcatcaaaggatagatgtaaaagacaccaaggaagccttagataagatagaggaagagcaaaacaaaagtaagaaaaaggcacagcaagcagcagctgacacaggaaacaacagccaggtcagccaaaattaccctatagtgcagaacctccaggggcaaatggtacatcaggccatatcacctagaactttaaatgcatgggtaaaagtagtagaagagaaggctttcagcccagaagtaatacccatgttttcagcattatcagaaggagccaccccacaagatttaaataccatgctaaacacagtggggggacatcaagcagccatgcaaatgttaaaagagaccatcaatgaggaagctgcagaatgggatagattgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaataaagataggggggcaattaaaggaagctctattagatacaggagcagatgatacagtattagaagaaatgaatttgccaggaagatggaaaccaaaaatgatagggggaattggaggttttatcaaagtaagacagtatgatcagatactcatagaaatctgcggacataaagctataggtacagtattagtaggacctacacctgtcaacataattggaagaaatctgttgactcagattggctgcactttaaattttcccattagtcctattgagactgtaccagtaaaattaaagccaggaatggatggcccaaaagttaaacaatggccattgacagaagaaaaaataaaagcattagtagaaatttgtacagaaatggaaaaggaaggaaaaatttcaaaaattgggcctgaaaatccatacaatactccagtatttgccataaagaaaaaagacagtactaaatggagaaaattagtagatttcagagaacttaataagagaactcaagatttctgggaagttcaattaggaataccacatcctgcagggttaaaacagaaaaaatcagtaacagtactggatgtgggcgatgcatatttttcagttcccttagataaagacttcaggaagtatactgcatttaccatacctagtataaacaatgagacaccagggattagatatcagtacaatgtgcttccacagggatggaaaggatcaccagcaatattccagtgtagcatgacaaaaatcttagagccttttagaaaacaaaatccagacatagtcatctatcaatacatggatgatttgtatgtaggatctgacttagaaatagggcagcatagaacaaaaatagaggaactgagacaacatctgttgaggtggggatttaccacaccagacaaaaaacatcagaaagaacctccattcctttggatgggttatgaactccatcctgataaatggacagtacagcctatagtgctgccagaaaaggacagctggactgtcaatgacatacagaaattagtgggaaaattgaattgggcaagtcagatttatgcagggattaaagtaaggcaattatgtaaacttcttaggggaaccaaagcactaacagaagtagtaccactaacagaagaagcagagctagaactggcagaaaacagggagattctaaaagaaccggtacatggagtgtattatgacccatcaaaagacttaatagcagaaatacagaagcaggggcaaggccaatggacatatcaaatttatcaagagccatttaaaaatctgaaaacaggaaagtatgcaagaatgaacgaatctgccgttgccatatacagcatctgaacaagctgatcgaacccttcatggacggttaaggccgcctgttggtgggcggggatcaagcaggaatttggcattccctacaatccccaaagtcaaggagtaatagaatctatgaataaagaattaaagaaaattataggacaggtaagagatcaggctgaacatcttaagacagcagtacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggaaaggaccagcaaagctcctctggaaaggtgaaggggcagtagtaatacaagataatagtgacataaaagtagtgccaagaagaaaagcaaagatcatcagggattaaccgtccatgaagggttcgattatctgtagccaacattcgatatggcaacggcagattcgttggagatgggggtggaaatggggcaccatgctccttgggatattgatgatctgtagtgctacagaaaaattgtgggtcacagtctattatggggtacctgtgtggaaggaagcaaccaccactctattttgtgcatcagatgctaaagcatatgatacagaggtacataatgtttgggccacacatgcctgtgtacccacagaccccaacccacaagaagtagtattggtaaatgtgacagaaaattttaacatgtggaaaaatgacatggtagaacagatgcatgaggatataatcagtttatgggatcaaagcctaaagccatgtgtaaaattaaccccactctgtgttagtttaaagtgcactgatttgaagaatgatactaataccaatagtagtagcgggagaatgataatggagaaaggagagataaaaaactgctctttcaatatcagcacaagcataagagataaggtgcagaaagaatatgcattcttttataaacttgatatagtaccaatagataataccagctataggttgataagttgtaacacctcagtcattacacaggcctgtccaaaggtatcctttgagccaattcccatacattattgtgccccggctggttttgcgattctaaaatgtaataataagacgttcaatggaacaggaccatgtacaaatgtcagcacagtacaatgtacacatggaatcaggccagtagtatcaactcaactgctgttaaatggcagtctagcagaagaagatgtagtaattagatctgccaatttcacagacaatgctaaaaccataatagtacagctgaacacatctgtagaaattaattgtacaagacccaacaacaatacaagaaaaagtatccgtatccagaggggaccagggagagcatttgttacaataggaaaaataggaaatatgagacaagcacattgtaacattagtagagcaaaatggaatgccactttaaaacagatagctagcaaattaagagaacaatttggaaataataaaacaataatctttaagcaatcctcaggaggggacccagaaattgtaacgcacagttttaattgtggaggggaatttttctactgtaattcaacacaactgtttaatagtacttggtttaatagtacttggagtactgaagggtcaaataacactgaaggaagtgacacaatcacactcccatgcagaataaaacaatttataaacatgtggcaggaagtaggaaaagcaatgtatgcccctcccatcagtggacaaattagatgttcatcaaatattactgggctgctattaacaagagatggtggtaataacaacaatgggtccgagatcttcagacctggaggaggcgatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctgatatagtgcagcagcagaacaatttgctgagggctattgaggcgcaacagcatctgttgcaactcacagtctggggcatcaaacagctccaggcaagaatcctggctgtggaaagatacctaaaggatcaacagctcctggggatttggggttgctctggaaaactcatttgcaccactgctgtgccttggaatgctagttggagtaataaatctctggaacagatttggaataacatgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaatcccgaggggacccgacaggcccgaaggaatagaagaagaaggtggagagagagacagagacagatccattcgattagtgaacggatccttagcacttatctgggacgatctgcggagcctgtgcctcttcagctaccaccgcttgagagacttactcttgattgtaacgaggattgtggaacttctgggacgcagggggtgggaagccctcaaatattggtggaatctcctacagtattggagtcaggaactaaagaatagtgctgttaacttgctcaatgccacagccatagcagtagctgaggggacagatagggttatagaagtattacaagcagcttatagagctattcgccacatacctagaagaataagacagggcttggaaaggattttgctataagatgggtggcaagtggtcaaaaagtagtgtgattggatggcctgctgtaagggaaagaatgagacgagctgagccagcagcagatggggtgggagcagtatctcgagacctagaaaaacatggagcaatcacaagtagcaatacagcagctaacaatgctgcttgtgcctggctagaagcacaagaggaggaagaggtgggttttccagtcacacctcaggtacctttaagaccaatgacttacaaggcagctgtagatcttagccactttttaaaagaaaaggggggactggaagggctaattcactcccaaagaagacaagatatccttaccgtccatgaagggttcgatcgtaaagtgggatagttttttatggcaacggcagattcgttgagcctgcatggaatggatgaccctgagagagaagtgttagagtggaggtttgacagccgcctagcatttcatcacgtggcccgagagctgcatccggagtacttcaagaactgctgacatcgagcttgctacaagggactttccgctggggactttccagggaggcgtggcctgggcgggactggggagtggcgagccctcagatgctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagca

SEQ ID NO: 76 - DNA, 8756 bp, Artificial Sequence
  Synthetic Sequence
tggaagggctaatttggtcccaaaaaagacaagagatccttgatctgtggatctaccacacacaaggctacttccctgattggcagaactacacaccagggccagggatcagatatccactgacctttggatggtgcttcaagttagtaccagttgaaccagagcaagtagaagaggccaatgaaggagagaacaacagcttgttacaccctatgagccagcatgggatggaggacccggagggagaagtattagtgtggaagtttgacagcctcctagcatttcgtcacatggcccgagagctgcatccggagtactacaaagactgctgacatcgagctttctacaagggactttccgctggggactttccagggaggtgtggcctgggcgggactggggagtggcgagccctcagatgctacatataagcagctgctttttgcctgtactgggtctctctggttagaccagatctgagcctgggagctctctggctaactagggaacccactgcttaagcctcaataaagcttgccttgagtgctcaaagtagtgtgtgcccgtctgttgtgtgactctggtaactagagatccctcagacccttttagtcagtgtggaaaatctctagcagtggcgcccgaacagggacttgaaagcgaaagtaaagccagaggagatctctcgacgcaggactcggcttgctgaagcgcgcacggcaagaggcgaggggcggcgactggtgagtacgccaaaaattttgactagcggaggctagaaggagagagatgggtgcgagagcgtcggtattaagcgggggagaattagataaatgggaaaaaattcggttaaggccagggggaaagaaacaatataaactaaaacatatagtatgggcaagcagggagctagaacgattcgcagttaatcctggccttttagagacatcagaaggctgtagacaaatactgggacagctacaaccatcccttcagacaggatcagaagaacttagatcattatataatacaatagcagtcctctattgtgtgcatcaaaggatagatgtaaaagacaccaaggaagccttagataagatagaggaagagcaaaacaaaagtaagaaaaaggcacagcaagcagcagctgacacaggaaacaacagccaggtcagccaaaattaccctatagtgcagaacctccaggggcaaatggtacatcaggccatatcacctagaactttaaatgcatgggtaaaagtagtagaagagaaggctttcagcccagaagtaatacccatgttttcagcattatcagaaggagccaccccacaagatttaaataccatgctaaacacagtggggggacatcaagcagccatgcaaatgttaaaagagaccatcaatgaggaagctgcagaatgggatagattgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattcaacgaatctgccgttgccatatgatccggccatgggttcaaatcgaacccttcatggacggtgtagaaatttgtacagaaatggaaaaggaaggaaaaatttcaaaaattgggcctgaaaatccatacaatactccagtatttgccataaagaaaaaagacagtactaaatggagaaaattagtagatttcagagaacttaataagagaactcaagatttctgggaagttcaattaggaataccacatcctgcagggttaaaacagaaaaaatcagtaacagtactggatgtgggcgatgcatatttttcagttcccttagataaagacttcaggaagtatactgcatttaccatacctagtataaacaatgagacaccagggattagatatcagtacaatgtgcttccacagggatggaaaggatcaccagcaatattccagtgtagcatgacaaaaatcttagagccttttagaaaacaaaatccagacatagtcatctatcaatacatggatgatttgtatgtaggatctgacttagaaatagggcagcatagaacaaaaatagaggaactgagacaacatctgttgaggtggggatttaccacaccagacaaaaaacatcagaaagaacctccattcctttggatgggttatgaactccatcctgataaatggacagtacagcctatagtgctgccagaaaaggacagctggactgtcaatgacatacagaaattagtgggaaaattgaattgggcaagtcagatttatgcagggattaaagtaaggcaattatgtaaacttcttaggggaaccaaagcactaacagaagtagtaccactaacagaagaagcagagctagaactggcagaaaacagggagattctaaaagaaccggtacatggagtgtattatgacccatcaaaagacttaatagcagaaatacagaagcaggggcaaggccaatggacatatcaaatttatcaagagccatttaaaaatctgaaaacaggaaagtatgcaagaatgaagggtgcccacactaatgatgtgaaacaattaacagaggcagtacaaaaaatagccacagaaagcatagtaatatggggaaagactcctaaatttaaattacccatacaaaaggaaacatgggaagcatggtggacagagtattggcaagccacctggattcctgagtgggagtttgtcaatacccctcccttagtgaagttatggtaccagttagagaaagaacccataataggagcagaaactttctatgtagatggggcagccaatagggaaactaaattaggaaaagcaggatatgtaactgacagaggaagacaaaaagttgtccccctaacggacacaacaaatcagaagactgagttacaagcaattcatctagctttgcaggattcgggattagaagtaaacatagtgacagactcacaatatgcattgggaatcattcaagcacaaccagataagagtgaatcagagttagtcagtcaaataatagagcagttaataaaaaaggaaaaagtctacctggcatgggtaccagcacacaaaggaattggaggaaatgaacaagtagataaattggtcagtgctggaatcaggaaagtactatttttagatggaatagataaggcccaagaagaacatgagaaatatcacagtaattggagagcaatggctagtgattttaacctaccacctgtagtagcaaaagaaatagtagccagctgtgataaatgtcagctaaaaggggaagccatgcatggacaagtagactgtagcccaggaatatggcagctagattgtacacatttagaaggaaaagttatcttggtagcagttcatgtagccagtggatatatagaagcagaagtaattccagcagagacagggcaagaaacagcatacttcctcttaaaattagcaggaagatggccagtaaaaacagtacatacagacaatggcagcaatttcaccagtactacagttaaggccgcctgttggtgggcggggatcaagcaggaatttggcattccctacaatccccaaagtcaaggagtaatagaatctatgaataaagaattaaagaaaattataggacaggtaagagatcaggctgaacatcttaagacagcagtacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggaaaggaccagcaaagctcctctggaaaggtgaaggggcagtagtaatacaagataatagtgacataaaagtagtgccaagaagaaaagcaaagatcatcagggattatggaaaacagatggcaggtgatgattgtgtggcaagtagacaggatgaggattaacacatggaaaagattagtaaaacaccatatgtatatttcaaggaaagctaaggactggttttatagacatcactatgaaagtactaatccaaaaataagttcagaagtacacatcccactaggggatgctaaattagtaataacaacatattggggtctgcatacaggagaaagagactggcatttgggtcagggagtctccatagaatggaggaaaaagagatatagcacacaagtagaccctgacctagcagaccaactaattcatctgcactattttgattgtttttcagaatctgctataagaaataccatattaggacgtatagttagtcctaggtgtgaatatcaagcaggacataacaaggtaggatctctacagtacttggcactagcagcattaataaaaccaaaacagataaagccacctttgcctagtgttaggaaactgacagaggacagatggaacaagccccagaagaccaagggccacagagggagccatacaatgaatggacactagagcttttagaggaacttaagagtgaagctgttagacattttcctaggatatggctccataacttaggacaacatatctatgaaacttacggggatacttgggcaggagtggaagccataataagaattctgcaacaactgctgtttatccatttcagaattgggtgtcgacatagcagaataggcgttactcgacagaggagagcaagaaatggagccagtagatcctagactagagccctggaagcatccaggaagtcagcctaaaactgcttgtaccaattgctattgtaaaaagtgttgctttcattgccaagtttgtttcatgacaaaagccttaggcatctcctatggcaggaagaagcggagacagcgacgaagagctcatcagaacagtcagactcatcaagcttctctatcaaagcagtaagtagtacatgtaatgcaacctataatagtagcaatagtagcattagtagtagcaataataatagcaatagttgtgtggtccatagtaatcatagaatataggaaaatattaagacaaagaaaaatagacaggttaattgatagactaatagaaagagcagaagacagtggcaatgagagtgaaggagaagtatcagcacttgtggagatgggggtggaaatggggcaccatgctccttgggatattgatgatctgtagtgctacagaaaaattgtgggtcacagtctattatggggtacctgtgtggaaggaagcaaccaccactctattttgtgcatcagatgctaaagcatatgatacagaggtacataatgtttgggccacacatgcctgtgtacccacagaccccaacccacaagaagtagtattggtaaatgtgacagaaaattttaacatgtggaaaaatgacatggtagaacagatgcatgaggatataatcagtttatgggatcaaagcctaaagccatgtgtaaaattaaccccactctgtgttagtttaaagtgcactgatttgaagaatgatactaataccaatagtagtagcgggagaatgataatggagaaaggagagataaaaaactgctctttcaatatcagcacaagcataagagataaggtgcagaaagaatatgcattcttttataaacttgatatagtaccaatagataataccagctataggttgataagttgtaacacctcagtcattacacaggcctgtccaaaggtatcctttgagccaattcccatacattattgtgccccggctggttttgcgattctaaaatgtaataataagacgttcaatggaacaggaccatgtacaaatgtcagcacagtacaatgtacacatggaatcaggccagtagtatcaactcaactgctgttaaatggcagtctagcagaagaagatgtagtaattagatctgccaatttcacagacaatgctaaaaccataatagtacagctgaacacatctgtagaaattaattgtacaagacccaacaacaatacaagaaaaagtatccgtatccagaggggaccagggagagcatttgttacaataggaaaaataggaaatatgagacaagcacattgtaacattagtagagcaaaatggaatgccactttaaaacagatagctagcaaattaagagaacaatttggaaataataaaacaataatctttaagcaatcctcaggaggggacccagaaattgtaacgcacagttttaattgtggaggggaatttttctactgtaattcaacacaactgtttaatagtacttggtttaatagtacttggagtactgaagggtcaaataacactgaaggaagtgacacaatcacactcccatgcagaataaaacaatttataaacatgtggcaggaagtaggaaaagcaatgtatgcccctcccatcagtggacaaattagatgttcatcaaatattactgggctgctattaacaagagatggtggtaataacaacaatgggtccgagatcttcagacctggaggaggcgatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctgatatagtgcagcagcagaacaatttgctgagggctattgaggcgcaacagcatctgttgcaactcacagtctggggcatcaaacagctccaggcaagaatcctggctgtggaaagatacctaaaggatcaacagctcctggggatttggggttgctctggaaaactcatttgcaccactgctgtgccttggaatgctagttggagtaataaatctctggaacagatttggaataacatgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaatcccgaggggacccgacaggcccgaaggaatagaagaagaaggtggagagagagacagagacagatccattcgattagtgaacggatccttagcacttatctgggacgatctgcggagcctgtgcctcttcagctaccaccgcttgagagacttactcttgattgtaacgaggattgtggaacttctgggacgcagggggtgggaagccctcaaatattggtggaatctcctacagtattggagtcaggaactaaagaatagtgctgttaacttgctcaatgccacagccatagcagtagctgaggggacagatagggttatagaagtattacaagcagcttatagagctattcgccacatacctagaagaataagacagggcttggaaaggattttgctataagatgggtggcaagtggtcaaaaagtagtgtgattggatggcctgctgtaagggaaagaatgagacgagctgagccagcagcagatggggtgggagcagtatctcgagacctagaaaaacatggagcaatcacaagtagcaatacagcagctaacaatgctgcttgtgcctggctagaagcacaagaggaggaagaggtgggttttccagtcacacctcaggtacctttaagaccaatgacttacaaggcagctgtagatcttagccactttttaaaagaaaaggggggactggaagggctaattcactcccaaagaagacaagatatccttgatctgtggatctaccacacacaaggctacttccctgattggcagaactacacaccagggccaggggtcagatatccactgacctttggatggtgctacaagctagtaccagttgagccagataaggtagaagaggccaataaaggagagaacaccagcttgttacaccctgtgagcctgcatggaatggatgaccctgagagagaagtgttagagtggaggtttgacagccgcctagcatttcatcacgtggcccgagagctgcatccggagtacttcaagaactgctgacatcgagcttgctacaagggactttccgctggggactttccagggaggcgtggcctgggcgggactggggagtggcgagccctcagatgctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagca

SEQ ID NO: 77 - DNA, 7833 bp, Artificial Sequence
  Synthetic Sequence
tggaagggctaatttggtcccaaaaaagacaagagatccttgatctgtggatctaccacacacaaggctacttccctgattggcagaactacacaccagggccagggatcagatatccactgacctttggatggtgcttcaagttagtaccagttgaaccagagcaagtagaagaggccaatgaaggagagaacaacagcttgttacaccctatgagccagcatgggatggaggacccggagggagaagtattagtgtggaagtttgacagcctcctagcatttcgtcacatggcccgagagctgcatccggagtactacaaagactgctgacatcgagctttctacaagggactttccgctggggactttccagggaggtgtggcctgggcgggactggggagtggcgagccctcagatgctacatataagcagctgctttttgcctgtactgggtctctctggttagaccagatctgagcctgggagctctctggctaactagggaacccactgcttaagcctcaataaagcttgccttgagtgctcaaagtagtgtgtgcccgtctgttgtgtgactctggtaactagagatccctcagacccttttagtcagtgtggaaaatctctagcagtggcgcccgaacagggacttgaaagcgaaagtaaagccagaggagatctctcgacgcaggactcggcttgctgaagcgcgcacggcaagaggcgaggggcggcgactggtgagtacgccaaaaattttgactagcggaggctagaaggagagagatgggtgcgagagcgtcggtattaagcgggggagaattagataaatgggaaaaaattcggttaaggccagggggaaagaaacaatataaactaaaacatatagtatgggcaagcagggagctagaacgattcgcagttaatcctggccttttagagacatcagaaggctgtagacaaatactgggacagctacaaccatcccttcagacaggatcagaagaacttagatcattatataatacaatagcagtcctctattgtgtgcatcaaaggatagatgtaaaagacaccaaggaagccttagataagatagaggaagagcaaaacaaaagtaagaaaaaggcacagcaagcagcagctgacacaggaaacaacagccaggtcagccaaaattaccctatagtgcagaacctccaggggcaaatggtacatcaggccatatcacctagaactttaaatgcatgggtaaaagtagtagaagagaaggctttcagcccagaagtaatacccatgttttcagcattatcagaaggagccaccccacaagatttaaataccatgctaaacacagtggggggacatcaagcagccatgcaaatgttaaaagagaccatcaatgaggaagctgcagaatgggatagattgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattcaacgaatctgccgttgccatatgatccggccatgggttcaaatcgaacccttcatggacggtgtagaaatttgtacagaaatggaaaaggaaggaaaaatttcaaaaattgggcctgaaaatccatacaatactccagtatttgccataaagaaaaaagacagtactaaatggagaaaattagtagatttcagagaacttaataagagaactcaagatttctgggaagttcaattaggaataccacatcctgcagggttaaaacagaaaaaatcagtaacagtactggatgtgggcgatgcatatttttcagttcccttagataaagacttcaggaagtatactgcatttaccatacctagtataaacaatgagacaccagggattagatatcagtacaatgtgcttccacagggatggaaaggatcaccagcaatattccagtgtagcatgacaaaaatcttagagccttttagaaaacaaaatccagacatagtcatctatcaatacatggatgatttgtatgtaggatctgacttagaaatagggcagcatagaacaaaaatagaggaactgagacaacatctgttgaggtggggatttaccacaccagacaaaaaacatcagaaagaacctccattcctttggatgggttatgaactccatcctgataaatggacagtacagcctatagtgctgccagaaaaggacagctggactgtcaatgacatacagaaattagtgggaaaattgaattgggcaagtcagatttatgcagggattaaagtaaggcaattatgtaaacttcttaggggaaccaaagcactaacagaagtagtaccactaacagaagaagcagagctagaactggcagaaaacagggagattctaaaagaaccggtacatggagtgtattatgacccatcaaaagacttaatagcagaaatacagaagcaggggcaaggccaatggacatatcaaatttatcaagagccatttaaaaatctgaaaacaggaaagtatgcaagaatgaagggtgcccacactaatgatgtgaaacaattaacagaggcagtacaaaaaatagccacagaaagcatagtaatatggggaaagactcctaaatttaaattacccatacaaaaggaaacatgggaagcatggtggacagagtattggcaagccacctggattcctgagtgggagtttgtcaatacccctcccttagtgaagttatggtaccagttagagaaagaacccataataggagcagaaactttctatgtagatggggcagccaatagggaaactaaattaggaaaagcaggatatgtaactgacagaggaagacaaaaagttgtccccctaacggacacaacaaatcagaagactgagttacaagcaattcatctagctttgcaggattcgggattagaagtaaacatagtgacagactcacaatatgcattgggaatcattcaagcacaaccagataagagtgaatcagagttagtcagtcaaataatagagcagttaataaaaaaggaaaaagtctacctggcatgggtaccagcacacaaaggaattggaggaaatgaacaagtagataaattggtcagtgctggaatcaggaaagtactatttttagatggaatagataaggcccaagaagaacatgagaaatatcacagtaattggagagcaatggctagtgattttaacctaccacctgtagtagcaaaagaaatagtagccagctgtgataaatgtcagctaaaaggggaagccatgcatggacaagtagactgtagcccaggaatatggcagctagattgtacacatttagaaggaaaagttatcttggtagcagttcatgtagccagtggatatatagaagcagaagtaattccagcagagacagggcaagaaacagcatacttcctcttaaaattagcaggaagatggccagtaaaaacagtacatacagacaatggcagcaatttcaccagtactacagttaaggccgcctgttggtgggcggggatcaagcaggaatttggcattccctacaatccccaaagtcaaggagtaatagaatctatgaataaagaattaaagaaaattataggacaggtaagagatcaggctgaacatcttaagacagcagtacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggaaaggaccagcaaagctcctctggaaaggtgaaggggcagtagtaatacaagataatagtgacataaaagtagtgccaagaagaaaagcaaagatcatcagggattatggaaaacagatggcaggtgatgattgtgtggcccgtccatgaagggttcgattcttgaacagcgcggtctgttatggcaacggcagattcgtttaatgcaacctataatagtagcaatagtagcattagtagtagcaataataatagcaatagttgtgtggtccatagtaatcatagaatataggaaaatattaagacaaagaaaaatagacaggttaattgatagactaatagaaagagcagaagacagtggcaatgagagtgaaggagaagtatcagcacttgtggagatgggggtggaaatggggcaccatgctccttgggatattgatgatctgtagtgctacagaaaaattgtgggtcacagtctattatggggtacctgtgtggaaggaagcaaccaccactctattttgtgcatcagatgctaaagcatatgatacagaggtacataatgtttgggccacacatgcctgtgtacccacagaccccaacccacaagaagtagtattggtaaatgtgacagaaaattttaacatgtggaaaaatgacatggtagaacagatgcatgaggatataatcagtttatgggatcaaagcctaaagccatgtgtaaaattaaccccactctgtgttagtttaaagtgcactgatttgaagaatgatactaataccaatagtagtagcgggagaatgataatggagaaaggagagataaaaaactgctctttcaatatcagcacaagcataagagataaggtgcagaaagaatatgcattcttttataaacttgatatagtaccaatagataataccagctataggttgataagttgtaacacctcagtcattacacaggcctgtccaaaggtatcctttgagccaattcccatacattattgtgccccggctggttttgcgattctaaaatgtaataataagacgttcaatggaacaggaccatgtacaaatgtcagcacagtacaatgtacacatggaatcaggccagtagtatcaactcaactgctgttaaatggcagtctagcagaagaagatgtagtaattagatctgccaatttcacagacaatgctaaaaccataatagtacagctgaacacatctgtagaaattaattgtacaagacccaacaacaatacaagaaaaagtatccgtatccagaggggaccagggagagcatttgttacaataggaaaaataggaaatatgagacaagcacattgtaacattagtagagcaaaatggaatgccactttaaaacagatagctagcaaattaagagaacaatttggaaataataaaacaataatctttaagcaatcctcaggaggggacccagaaattgtaacgcacagttttaattgtggaggggaatttttctactgtaattcaacacaactgtttaatagtacttggtttaatagtacttggagtactgaagggtcaaataacactgaaggaagtgacacaatcacactcccatgcagaataaaacaatttataaacatgtggcaggaagtaggaaaagcaatgtatgcccctcccatcagtggacaaattagatgttcatcaaatattactgggctgctattaacaagagatggtggtaataacaacaatgggtccgagatcttcagacctggaggaggcgatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctgatatagtgcagcagcagaacaatttgctgagggctattgaggcgcaacagcatctgttgcaactcacagtctggggcatcaaacagctccaggcaagaatcctggctgtggaaagatacctaaaggatcaacagctcctggggatttggggttgctctggaaaactcatttgcaccactgctgtgccttggaatgctagttggagtaataaatctctggaacagatttggaataacatgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaatcccgaggggacccgacaggcccgaaggaatagaagaagaaggtggagagagagacagagacagatccattcgattagtgaacggatccttagcacttatctgggacgatctgcggagcctgtgcctcttcagctaccaccgcttgagagacttactcttgattgtaacgaggattgtggaacttctgggacgcagggggtgggaagccctcaaatattggtggaatctcctacagtattggagtcaggaactaaagaatagtgctgttaacttgctcaatgccacagccatagcagtagctgaggggacagatagggttatagaagtattacaagcagcttatagagctattcgccacatacctagaagaataagacagggcttggaaaggattttgctataagatgggtggcaagtggtcaaaaagtagtgtgattggatggcctgctgtaagggaaagaatgagacgagctgagccagcagcagatggggtgggagcagtatctcgagacctagaaaaacatggagcaatcacaagtagcaatacagcagctaacaatgctgcttgtgcctggctagaagcacaagaggaggaagaggtgggttttccagtcacacctcaggtacctttaagaccaatgacttacaaggcagctgtagatcttagccactttttaaaagaaaaggggggactggaagggctaattcactcccaaagaagacaagatatccttgatctgtggatctaccacacacaaggctacttccctgattggcagaactacacaccagggccaggggtcagatatccactgacctttggatggtgctacaagctagtaccagttgagccagataaggtagaagaggccaataaaggagagaacaccagcttgttacaccctgtgagcctgcatggaatggatgaccctgagagagaagtgttagagtggaggtttgacagccgcctagcatttcatcacgtggcccgagagctgcatccggagtacttcaagaactgctgacatcgagcttgctacaagggactttccgctggggactttccagggaggcgtggcctgggcgggactggggagtggcgagccctcagatgctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagca

SEQ ID NO: 78 - DNA, 7608 bp, Artificial Sequence
  Synthetic Sequence
tggaagggctaatttggtcccaaaaaagacaagagatccttgatctgtggatctaccacacacaaggctacttccctgattggcagaactacacaccagggccagggatcagatatccactgacctttggatggtgcttcaagttagtaccagttgaaccagagcaagtagaagaggccaatgaaggagagaacaacagcttgttacaccctatgagccagcatgggatggaggacccggagggagaagtattagtgtggaagtttgacagcctcctagcatttcgtcacatggcccgagagctgcatccggagtactacaaagactgctgacatcgagctttctacaagggactttccgctggggactttccagggaggtgtggcctgggcgggactggggagtggcgagccctcagatgctacatataagcagctgctttttgcctgtactgggtctctctggttagaccagatctgagcctgggagctctctggctaactagggaacccactgcttaagcctcaataaagcttgccttgagtgctcaaagtagtgtgtgcccgtctgttgtgtgactctggtaactagagatccctcagacccttttagtcagtgtggaaaatctctagcagtggcgcccgaacagggacttgaaagcgaaagtaaagccagaggagatctctcgacgcaggactcggcttgctgaagcgcgcacggcaagaggcgaggggcggcgactggtgagtacgccaaaaattttgactagcggaggctagaaggagagagatgggtgcgagagcgtcggtattaagcgggggagaattagataaatgggaaaaaattcggttaaggccagggggaaagaaacaatataaactaaaacatatagtatgggcaagcagggagctagaacgattcgcagttaatcctggccttttagagacatcagaaggctgtagacaaatactgggacagctacaaccatcccttcagacaggatcagaagaacttagatcattatataatacaatagcagtcctctattgtgtgcatcaaaggatagatgtaaaagacaccaaggaagccttagataagatagaggaagagcaaaacaaaagtaagaaaaaggcacagcaagcagcagctgacacaggaaacaacagccaggtcagccaaaattaccctatagtgcagaacctccaggggcaaatggtacatcaggccatatcacctagaactttaaatgcatgggtaaaagtagtagaagagaaggctttcagcccagaagtaatacccatgttttcagcattatcagaaggagccaccccacaagatttaaataccatgctaaacacagtggggggacatcaagcagccatgcaaatgttaaaagagaccatcaatgaggaagctgcagaatgggatagattgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattcaacgaatctgccgttgccatatgatccggccatgggttcaaatcgaacccttcatggacggtgtagaaatttgtacagaaatggaaaaggaaggaaaaatttcaaaaattgggcctgaaaatccatacaatactccagtatttgccataaagaaaaaagacagtactaaatggagaaaattagtagatttcagagaacttaataagagaactcaagatttctgggaagttcaattaggaataccacatcctgcagggttaaaacagaaaaaatcagtaacagtactggatgtgggcgatgcatatttttcagttcccttagataaagacttcaggaagtatactgcatttaccatacctagtataaacaatgagacaccagggattagatatcagtacaatgtgcttccacagggatggaaaggatcaccagcaatattccagtgtagcatgacaaaaatcttagagccttttagaaaacaaaatccagacatagtcatctatcaatacatggatgatttgtatgtaggatctgacttagaaatagggcagcatagaacaaaaatagaggaactgagacaacatctgttgaggtggggatttaccacaccagacaaaaaacatcagaaagaacctccattcctttggatgggttatgaactccatcctgataaatggacagtacagcctatagtgctgccagaaaaggacagctggactgtcaatgacatacagaaattagtgggaaaattgaattgggcaagtcagatttatgcagggattaaagtaaggcaattatgtaaacttcttaggggaaccaaagcactaacagaagtagtaccactaacagaagaagcagagctagaactggcagaaaacagggagattctaaaagaaccggtacatggagtgtattatgacccatcaaaagacttaatagcagaaatacagaagcaggggcaaggccaatggacatatcaaatttatcaagagccatttaaaaatctgaaaacaggaaagtatgcaagaatgaagggtgcccacactaatgatgtgaaacaattaacagaggcagtacaaaaaatagccacagaaagcatagtaatatggggaaagactcctaaatttaaattacccatacaaaaggaaacatgggaagcatggtggacagagtattggcaagccacctggattcctgagtgggagtttgtcaatacccctcccttagtgaagttatggtaccagttagagaaagaacccataataggagcagaaactttctatgtagatggggcagccaatagggaaactaaattaggaaaagcaggatatgtaactgacagaggaagacaaaaagttgtccccctaacggacacaacaaatcagaagactgagttacaagcaattcatctagctttgcaggattcgggattagaagtaaacatagtgacagactcacaatatgcattgggaatcattcaagcacaaccagataagagtgaatcagagttagtcagtcaaataatagagcagttaataaaaaaggaaaaagtctacctggcatgggtaccagcacacaaaggaattggaggaaatgaacaagtagataaattggtcagtgctggaatcaggaaagtactatttttagatggaatagataaggcccaagaagaacatgagaaatatcacagtaattggagagcaatggctagtgattttaacctaccacctgtagtagcaaaagaaatagtagccagctgtgataaatgtcagctaaaaggggaagccatgcatggacaagtagactgtagcccaggaatatggcagctagattgtacacatttagaaggaaaagttatcttggtagcagttcatgtagccagtggatatatagaagcagaagtaattccagcagagacagggcaagaaacagcatacttcctcttaaaattagcaggaagatggccagtaaaaacagtacatacagacaatggcagcaatttcaccagtactacagttaaggccgcctgttggtgggcggggatcaagcaggaatttggcattccctacaatccccaaagtcaaggagtaatagaatctatgaataaagaattaaagaaaattataggacaggtaagagatcaggctgaacatcttaagacagcagtacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggaaaggaccagcaaagctcctctggaaaggtgaaggggcagtagtaatacaagataatagtgacataaaagtagtgccaagaagaaaagcaaagatcatcagggattaaccgtccatgaagggttcgattatctgtagccaacattcgatatggcaacggcagattcgttggagatgggggtggaaatggggcaccatgctccttgggatattgatgatctgtagtgctacagaaaaattgtgggtcacagtctattatggggtacctgtgtggaaggaagcaaccaccactctattttgtgcatcagatgctaaagcatatgatacagaggtacataatgtttgggccacacatgcctgtgtacccacagaccccaacccacaagaagtagtattggtaaatgtgacagaaaattttaacatgtggaaaaatgacatggtagaacagatgcatgaggatataatcagtttatgggatcaaagcctaaagccatgtgtaaaattaaccccactctgtgttagtttaaagtgcactgatttgaagaatgatactaataccaatagtagtagcgggagaatgataatggagaaaggagagataaaaaactgctctttcaatatcagcacaagcataagagataaggtgcagaaagaatatgcattcttttataaacttgatatagtaccaatagataataccagctataggttgataagttgtaacacctcagtcattacacaggcctgtccaaaggtatcctttgagccaattcccatacattattgtgccccggctggttttgcgattctaaaatgtaataataagacgttcaatggaacaggaccatgtacaaatgtcagcacagtacaatgtacacatggaatcaggccagtagtatcaactcaactgctgttaaatggcagtctagcagaagaagatgtagtaattagatctgccaatttcacagacaatgctaaaaccataatagtacagctgaacacatctgtagaaattaattgtacaagacccaacaacaatacaagaaaaagtatccgtatccagaggggaccagggagagcatttgttacaataggaaaaataggaaatatgagacaagcacattgtaacattagtagagcaaaatggaatgccactttaaaacagatagctagcaaattaagagaacaatttggaaataataaaacaataatctttaagcaatcctcaggaggggacccagaaattgtaacgcacagttttaattgtggaggggaatttttctactgtaattcaacacaactgtttaatagtacttggtttaatagtacttggagtactgaagggtcaaataacactgaaggaagtgacacaatcacactcccatgcagaataaaacaatttataaacatgtggcaggaagtaggaaaagcaatgtatgcccctcccatcagtggacaaattagatgttcatcaaatattactgggctgctattaacaagagatggtggtaataacaacaatgggtccgagatcttcagacctggaggaggcgatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctgatatagtgcagcagcagaacaatttgctgagggctattgaggcgcaacagcatctgttgcaactcacagtctggggcatcaaacagctccaggcaagaatcctggctgtggaaagatacctaaaggatcaacagctcctggggatttggggttgctctggaaaactcatttgcaccactgctgtgccttggaatgctagttggagtaataaatctctggaacagatttggaataacatgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaatcccgaggggacccgacaggcccgaaggaatagaagaagaaggtggagagagagacagagacagatccattcgattagtgaacggatccttagcacttatctgggacgatctgcggagcctgtgcctcttcagctaccaccgcttgagagacttactcttgattgtaacgaggattgtggaacttctgggacgcagggggtgggaagccctcaaatattggtggaatctcctacagtattggagtcaggaactaaagaatagtgctgttaacttgctcaatgccacagccatagcagtagctgaggggacagatagggttatagaagtattacaagcagcttatagagctattcgccacatacctagaagaataagacagggcttggaaaggattttgctataagatgggtggcaagtggtcaaaaagtagtgtgattggatggcctgctgtaagggaaagaatgagacgagctgagccagcagcagatggggtgggagcagtatctcgagacctagaaaaacatggagcaatcacaagtagcaatacagcagctaacaatgctgcttgtgcctggctagaagcacaagaggaggaagaggtgggttttccagtcacacctcaggtacctttaagaccaatgacttacaaggcagctgtagatcttagccactttttaaaagaaaaggggggactggaagggctaattcactcccaaagaagacaagatatccttgatctgtggatctaccacacacaaggctacttccctgattggcagaactacacaccagggccaggggtcagatatccactgacctttggatggtgctacaagctagtaccagttgagccagataaggtagaagaggccaataaaggagagaacaccagcttgttacaccctgtgagcctgcatggaatggatgaccctgagagagaagtgttagagtggaggtttgacagccgcctagcatttcatcacgtggcccgagagctgcatccggagtacttcaagaactgctgacatcgagcttgctacaagggactttccgctggggactttccagggaggcgtggcctgggcgggactggggagtggcgagccctcagatgctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagca

SEQ ID NO: 79 - DNA, 7832 bp, Artificial Sequence
  Synthetic Sequence
tggaagggctaatttggtcccaaaaaagacaagagatccttgatctgtggatctaccacacacaaggctacttccctgattggcagaactacacaccagggccagggatcagatatccactgacctttggatggtgcttcaagttagtaccagttgaaccagagcaagtagaagaggccaatgaaggagagaacaacagcttgttacaccctatgagccagcatgggatggaggacccggagggagaagtattagtgtggaagtttgacagcctcctagcatttcgtcacatggcccgagagctgcatccggagtactacaaagactgctgacatcgagctttctacaagggactttccgctggggactttccagggaggtgtggcctgggcgggactggggagtggcgagccctcagatgctacatataagcagctgctttttgcctgtactgggtctctctggttagaccagatctgagcctgggagctctctggctaactagggaacccactgcttaagcctcaataaagcttgccttgagtgctcaaagtagtgtgtgcccgtctgttgtgtgactctggtaactagagatccctcagacccttttagtcagtgtggaaaatctctagcagtggcgcccgaacagggacttgaaagcgaaagtaaagccagaggagatctctcgacgcaggactcggcttgctgaagcgcgcacggcaagaggcgaggggcggcgactggtgagtacgccaaaaattttgactagcggaggctagaaggagagagatgggtgcgagagcgtcggtattaagcgggggagaattagataaatgggaaaaaattcggttaaggccagggggaaagaaacaatataaactaaaacatatagtatgggcaagcagggagctagaacgattcgcagttaatcctggccttttagagacatcagaaggctgtagacaaatactgggacagctacaaccatcccttcagacaggatcagaagaacttagatcattatataatacaatagcagtcctctattgtgtgcatcaaaggatagatgtaaaagacaccaaggaagccttagataagatagaggaagagcaaaacaaaagtaagaaaaaggcacagcaagcagcagctgacacaggaaacaacagccaggtcagccaaaattaccctatagtgcagaacctccaggggcaaatggtacatcaggccatatcacctagaactttaaatgcatgggtaaaagtagtagaagagaaggctttcagcccagaagtaatacccatgttttcagcattatcagaaggagccaccccacaagatttaaataccatgctaaacacagtggggggacatcaagcagccatgcaaatgttaaaagagaccatcaatgaggaagctgcagaatgggatagattgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattcaacgaatctgccgttgccatatgatccggccatgggttcaaatcgaacccttcatggacggtgtagaaatttgtacagaaatggaaaaggaaggaaaaatttcaaaaattgggcctgaaaatccatacaatactccagtatttgccataaagaaaaaagacagtactaaatggagaaaattagtagatttcagagaacttaataagagaactcaagatttctgggaagttcaattaggaataccacatcctgcagggttaaaacagaaaaaatcagtaacagtactggatgtgggcgatgcatatttttcagttcccttagataaagacttcaggaagtatactgcatttaccatacctagtataaacaatgagacaccagggattagatatcagtacaatgtgcttccacagggatggaaaggatcaccagcaatattccagtgtagcatgacaaaaatcttagagccttttagaaaacaaaatccagacatagtcatctatcaatacatggatgatttgtatgtaggatctgacttagaaatagggcagcatagaacaaaaatagaggaactgagacaacatctgttgaggtggggatttaccacaccagacaaaaaacatcagaaagaacctccattcctttggatgggttatgaactccatcctgataaatggacagtacagcctatagtgctgccagaaaaggacagctggactgtcaatgacatacagaaattagtgggaaaattgaattgggcaagtcagatttatgcagggattaaagtaaggcaattatgtaaacttcttaggggaaccaaagcactaacagaagtagtaccactaacagaagaagcagagctagaactggcagaaaacagggagattctaaaagaaccggtacatggagtgtattatgacccatcaaaagacttaatagcagaaatacagaagcaggggcaaggccaatggacatatcaaatttatcaagagccatttaaaaatctgaaaacaggaaagtatgcaagaatgaacgaatctgccgttgccatatacagcatctgaacaagctgatcgaacccttcatggacggttaaggccgcctgttggtgggcggggatcaagcaggaatttggcattccctacaatccccaaagtcaaggagtaatagaatctatgaataaagaattaaagaaaattataggacaggtaagagatcaggctgaacatcttaagacagcagtacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggaaaggaccagcaaagctcctctggaaaggtgaaggggcagtagtaatacaagataatagtgacataaaagtagtgccaagaagaaaagcaaagatcatcagggattatggaaaacagatggcaggtgatgattgtgtggcaagtagacaggatgaggattaacacatggaaaagattagtaaaacaccatatgtatatttcaaggaaagctaaggactggttttatagacatcactatgaaagtactaatccaaaaataagttcagaagtacacatcccactaggggatgctaaattagtaataacaacatattggggtctgcatacaggagaaagagactggcatttgggtcagggagtctccatagaatggaggaaaaagagatatagcacacaagtagaccctgacctagcagaccaactaattcatctgcactattttgattgtttttcagaatctgctataagaaataccatattaggacgtatagttagtcctaggtgtgaatatcaagcaggacataacaaggtaggatctctacagtacttggcactagcagcattaataaaaccaaaacagataaagccacctttgcctagtgttaggaaactgacagaggacagatggaacaagccccagaagaccaagggccacagagggagccatacaatgaatggacactagagcttttagaggaacttaagagtgaagctgttagacattttcctaggatatggctccataacttaggacaacatatctatgaaacttacggggatacttgggcaggagtggaagccataataagaattctgcaacaactgctgtttatccatttcagaattgggtgtcgacatagcagaataggcgttactcgacagaggagagcaagaaatggagccagtagatcctagactagagccctggaagcatccaggaagtcagcctaaaactgcttgtaccaattgctattgtaaaaagtgttgctttcattgccaagtttgtttcatgacaaaagccttaggcatctcctatggcaggaagaagcggagacagcgacgaagagctcatcagaacagtcagactcatcaagcttctctatcaaagcagtaagtagtacatgtaatgcaacctataatagtagcaatagtagcattagtagtagcaataataatagcaatagttgtgtggtccatagtaatcatagaatataggaaaatattaagacaaagaaaaatagacaggttaattgatagactaatagaaagagcagaagacagtggcaatgagagtgaaggagaagtatcagcacttgtggagatgggggtggaaatggggcaccatgctccttgggatattgatgatctgtagtgctacagaaaaattgtgggtcacagtctattatggggtacctgtgtggaaggaagcaaccaccactctattttgtgcatcagatgctaaagcatatgatacagaggtacataatgtttgggccacacatgcctgtgtacccacagaccccaacccacaagaagtagtattggtaaatgtgacagaaaattttaacatgtggaaaaatgacatggtagaacagatgcatgaggatataatcagtttatgggatcaaagcctaaagccatgtgtaaaattaaccccactctgtgttagtttaaagtgcactgatttgaagaatgatactaataccaatagtagtagcgggagaatgataatggagaaaggagagataaaaaactgctctttcaatatcagcacaagcataagagataaggtgcagaaagaatatgcattcttttataaacttgatatagtaccaatagataataccagctataggttgataagttgtaacacctcagtcattacacaggcctgtccaaaggtatcctttgagccaattcccatacattattgtgccccggctggttttgcgattctaaaatgtaataataagacgttcaatggaacaggaccatgtacaaatgtcagcacagtacaatgtacacatggaatcaggccagtagtatcaactcaactgctgttaaatggcagtctagcagaagaagatgtagtaattagatctgccaatttcacagacaatgctaaaaccataatagtacagctgaacacatctgtagaaattaattgtacaagacccaacaacaatacaagaaaaagtatccgtatccagaggggaccagggagagcatttgttacaataggaaaaataggaaatatgagacaagcacattgtaacattagtagagcaaaatggaatgccactttaaaacagatagctagcaaattaagagaacaatttggaaataataaaacaataatctttaagcaatcctcaggaggggacccagaaattgtaacgcacagttttaattgtggaggggaatttttctactgtaattcaacacaactgtttaatagtacttggtttaatagtacttggagtactgaagggtcaaataacactgaaggaagtgacacaatcacactcccatgcagaataaaacaatttataaacatgtggcaggaagtaggaaaagcaatgtatgcccctcccatcagtggacaaattagatgttcatcaaatattactgggctgctattaacaagagatggtggtaataacaacaatgggtccgagatcttcagacctggaggaggcgatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctgatatagtgcagcagcagaacaatttgctgagggctattgaggcgcaacagcatctgttgcaactcacagtctggggcatcaaacagctccaggcaagaatcctggctgtggaaagatacctaaaggatcaacagctcctggggatttggggttgctctggaaaactcatttgcaccactgctgtgccttggaatgctagttggagtaataaatctctggaacagatttggaataacatgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaatcccgaggggacccgacaggcccgaaggaatagaagaagaaggtggagagagagacagagacagatccattcgattagtgaacggatccttagcacttatctgggacgatctgcggagcctgtgcctcttcagctaccaccgcttgagagacttactcttgattgtaacgaggattgtggaacttctgggacgcagggggtgggaagccctcaaatattggtggaatctcctacagtattggagtcaggaactaaagaatagtgctgttaacttgctcaatgccacagccatagcagtagctgaggggacagatagggttatagaagtattacaagcagcttatagagctattcgccacatacctagaagaataagacagggcttggaaaggattttgctataagatgggtggcaagtggtcaaaaagtagtgtgattggatggcctgctgtaagggaaagaatgagacgagctgagccagcagcagatggggtgggagcagtatctcgagacctagaaaaacatggagcaatcacaagtagcaatacagcagctaacaatgctgcttgtgcctggctagaagcacaagaggaggaagaggtgggttttccagtcacacctcaggtacctttaagaccaatgacttacaaggcagctgtagatcttagccactttttaaaagaaaaggggggactggaagggctaattcactcccaaagaagacaagatatccttgatctgtggatctaccacacacaaggctacttccctgattggcagaactacacaccagggccaggggtcagatatccactgacctttggatggtgctacaagctagtaccagttgagccagataaggtagaagaggccaataaaggagagaacaccagcttgttacaccctgtgagcctgcatggaatggatgaccctgagagagaagtgttagagtggaggtttgacagccgcctagcatttcatcacgtggcccgagagctgcatccggagtacttcaagaactgctgacatcgagcttgctacaagggactttccgctggggactttccagggaggcgtggcctgggcgggactggggagtggcgagccctcagatgctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagca

SEQ ID NO: 80 - DNA, 6909 bp, Artificial Sequence
  Synthetic Sequence
tggaagggctaatttggtcccaaaaaagacaagagatccttgatctgtggatctaccacacacaaggctacttccctgattggcagaactacacaccagggccagggatcagatatccactgacctttggatggtgcttcaagttagtaccagttgaaccagagcaagtagaagaggccaatgaaggagagaacaacagcttgttacaccctatgagccagcatgggatggaggacccggagggagaagtattagtgtggaagtttgacagcctcctagcatttcgtcacatggcccgagagctgcatccggagtactacaaagactgctgacatcgagctttctacaagggactttccgctggggactttccagggaggtgtggcctgggcgggactggggagtggcgagccctcagatgctacatataagcagctgctttttgcctgtactgggtctctctggttagaccagatctgagcctgggagctctctggctaactagggaacccactgcttaagcctcaataaagcttgccttgagtgctcaaagtagtgtgtgcccgtctgttgtgtgactctggtaactagagatccctcagacccttttagtcagtgtggaaaatctctagcagtggcgcccgaacagggacttgaaagcgaaagtaaagccagaggagatctctcgacgcaggactcggcttgctgaagcgcgcacggcaagaggcgaggggcggcgactggtgagtacgccaaaaattttgactagcggaggctagaaggagagagatgggtgcgagagcgtcggtattaagcgggggagaattagataaatgggaaaaaattcggttaaggccagggggaaagaaacaatataaactaaaacatatagtatgggcaagcagggagctagaacgattcgcagttaatcctggccttttagagacatcagaaggctgtagacaaatactgggacagctacaaccatcccttcagacaggatcagaagaacttagatcattatataatacaatagcagtcctctattgtgtgcatcaaaggatagatgtaaaagacaccaaggaagccttagataagatagaggaagagcaaaacaaaagtaagaaaaaggcacagcaagcagcagctgacacaggaaacaacagccaggtcagccaaaattaccctatagtgcagaacctccaggggcaaatggtacatcaggccatatcacctagaactttaaatgcatgggtaaaagtagtagaagagaaggctttcagcccagaagtaatacccatgttttcagcattatcagaaggagccaccccacaagatttaaataccatgctaaacacagtggggggacatcaagcagccatgcaaatgttaaaagagaccatcaatgaggaagctgcagaatgggatagattgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattcaacgaatctgccgttgccatatgatccggccatgggttcaaatcgaacccttcatggacggtgtagaaatttgtacagaaatggaaaaggaaggaaaaatttcaaaaattgggcctgaaaatccatacaatactccagtatttgccataaagaaaaaagacagtactaaatggagaaaattagtagatttcagagaacttaataagagaactcaagatttctgggaagttcaattaggaataccacatcctgcagggttaaaacagaaaaaatcagtaacagtactggatgtgggcgatgcatatttttcagttcccttagataaagacttcaggaagtatactgcatttaccatacctagtataaacaatgagacaccagggattagatatcagtacaatgtgcttccacagggatggaaaggatcaccagcaatattccagtgtagcatgacaaaaatcttagagccttttagaaaacaaaatccagacatagtcatctatcaatacatggatgatttgtatgtaggatctgacttagaaatagggcagcatagaacaaaaatagaggaactgagacaacatctgttgaggtggggatttaccacaccagacaaaaaacatcagaaagaacctccattcctttggatgggttatgaactccatcctgataaatggacagtacagcctatagtgctgccagaaaaggacagctggactgtcaatgacatacagaaattagtgggaaaattgaattgggcaagtcagatttatgcagggattaaagtaaggcaattatgtaaacttcttaggggaaccaaagcactaacagaagtagtaccactaacagaagaagcagagctagaactggcagaaaacagggagattctaaaagaaccggtacatggagtgtattatgacccatcaaaagacttaatagcagaaatacagaagcaggggcaaggccaatggacatatcaaatttatcaagagccatttaaaaatctgaaaacaggaaagtatgcaagaatgaacgaatctgccgttgccatatacagcatctgaacaagctgatcgaacccttcatggacggttaaggccgcctgttggtgggcggggatcaagcaggaatttggcattccctacaatccccaaagtcaaggagtaatagaatctatgaataaagaattaaagaaaattataggacaggtaagagatcaggctgaacatcttaagacagcagtacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggaaaggaccagcaaagctcctctggaaaggtgaaggggcagtagtaatacaagataatagtgacataaaagtagtgccaagaagaaaagcaaagatcatcagggattatggaaaacagatggcaggtgatgattgtgtggcccgtccatgaagggttcgattcttgaacagcgcggtctgttatggcaacggcagattcgtttaatgcaacctataatagtagcaatagtagcattagtagtagcaataataatagcaatagttgtgtggtccatagtaatcatagaatataggaaaatattaagacaaagaaaaatagacaggttaattgatagactaatagaaagagcagaagacagtggcaatgagagtgaaggagaagtatcagcacttgtggagatgggggtggaaatggggcaccatgctccttgggatattgatgatctgtagtgctacagaaaaattgtgggtcacagtctattatggggtacctgtgtggaaggaagcaaccaccactctattttgtgcatcagatgctaaagcatatgatacagaggtacataatgtttgggccacacatgcctgtgtacccacagaccccaacccacaagaagtagtattggtaaatgtgacagaaaattttaacatgtggaaaaatgacatggtagaacagatgcatgaggatataatcagtttatgggatcaaagcctaaagccatgtgtaaaattaaccccactctgtgttagtttaaagtgcactgatttgaagaatgatactaataccaatagtagtagcgggagaatgataatggagaaaggagagataaaaaactgctctttcaatatcagcacaagcataagagataaggtgcagaaagaatatgcattcttttataaacttgatatagtaccaatagataataccagctataggttgataagttgtaacacctcagtcattacacaggcctgtccaaaggtatcctttgagccaattcccatacattattgtgccccggctggttttgcgattctaaaatgtaataataagacgttcaatggaacaggaccatgtacaaatgtcagcacagtacaatgtacacatggaatcaggccagtagtatcaactcaactgctgttaaatggcagtctagcagaagaagatgtagtaattagatctgccaatttcacagacaatgctaaaaccataatagtacagctgaacacatctgtagaaattaattgtacaagacccaacaacaatacaagaaaaagtatccgtatccagaggggaccagggagagcatttgttacaataggaaaaataggaaatatgagacaagcacattgtaacattagtagagcaaaatggaatgccactttaaaacagatagctagcaaattaagagaacaatttggaaataataaaacaataatctttaagcaatcctcaggaggggacccagaaattgtaacgcacagttttaattgtggaggggaatttttctactgtaattcaacacaactgtttaatagtacttggtttaatagtacttggagtactgaagggtcaaataacactgaaggaagtgacacaatcacactcccatgcagaataaaacaatttataaacatgtggcaggaagtaggaaaagcaatgtatgcccctcccatcagtggacaaattagatgttcatcaaatattactgggctgctattaacaagagatggtggtaataacaacaatgggtccgagatcttcagacctggaggaggcgatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctgatatagtgcagcagcagaacaatttgctgagggctattgaggcgcaacagcatctgttgcaactcacagtctggggcatcaaacagctccaggcaagaatcctggctgtggaaagatacctaaaggatcaacagctcctggggatttggggttgctctggaaaactcatttgcaccactgctgtgccttggaatgctagttggagtaataaatctctggaacagatttggaataacatgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaatcccgaggggacccgacaggcccgaaggaatagaagaagaaggtggagagagagacagagacagatccattcgattagtgaacggatccttagcacttatctgggacgatctgcggagcctgtgcctcttcagctaccaccgcttgagagacttactcttgattgtaacgaggattgtggaacttctgggacgcagggggtgggaagccctcaaatattggtggaatctcctacagtattggagtcaggaactaaagaatagtgctgttaacttgctcaatgccacagccatagcagtagctgaggggacagatagggttatagaagtattacaagcagcttatagagctattcgccacatacctagaagaataagacagggcttggaaaggattttgctataagatgggtggcaagtggtcaaaaagtagtgtgattggatggcctgctgtaagggaaagaatgagacgagctgagccagcagcagatggggtgggagcagtatctcgagacctagaaaaacatggagcaatcacaagtagcaatacagcagctaacaatgctgcttgtgcctggctagaagcacaagaggaggaagaggtgggttttccagtcacacctcaggtacctttaagaccaatgacttacaaggcagctgtagatcttagccactttttaaaagaaaaggggggactggaagggctaattcactcccaaagaagacaagatatccttgatctgtggatctaccacacacaaggctacttccctgattggcagaactacacaccagggccaggggtcagatatccactgacctttggatggtgctacaagctagtaccagttgagccagataaggtagaagaggccaataaaggagagaacaccagcttgttacaccctgtgagcctgcatggaatggatgaccctgagagagaagtgttagagtggaggtttgacagccgcctagcatttcatcacgtggcccgagagctgcatccggagtacttcaagaactgctgacatcgagcttgctacaagggactttccgctggggactttccagggaggcgtggcctgggcgggactggggagtggcgagccctcagatgctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagca

SEQ ID NO: 81 - DNA, 6684 bp, Artificial Sequence
  Synthetic Sequence
tggaagggctaatttggtcccaaaaaagacaagagatccttgatctgtggatctaccacacacaaggctacttccctgattggcagaactacacaccagggccagggatcagatatccactgacctttggatggtgcttcaagttagtaccagttgaaccagagcaagtagaagaggccaatgaaggagagaacaacagcttgttacaccctatgagccagcatgggatggaggacccggagggagaagtattagtgtggaagtttgacagcctcctagcatttcgtcacatggcccgagagctgcatccggagtactacaaagactgctgacatcgagctttctacaagggactttccgctggggactttccagggaggtgtggcctgggcgggactggggagtggcgagccctcagatgctacatataagcagctgctttttgcctgtactgggtctctctggttagaccagatctgagcctgggagctctctggctaactagggaacccactgcttaagcctcaataaagcttgccttgagtgctcaaagtagtgtgtgcccgtctgttgtgtgactctggtaactagagatccctcagacccttttagtcagtgtggaaaatctctagcagtggcgcccgaacagggacttgaaagcgaaagtaaagccagaggagatctctcgacgcaggactcggcttgctgaagcgcgcacggcaagaggcgaggggcggcgactggtgagtacgccaaaaattttgactagcggaggctagaaggagagagatgggtgcgagagcgtcggtattaagcgggggagaattagataaatgggaaaaaattcggttaaggccagggggaaagaaacaatataaactaaaacatatagtatgggcaagcagggagctagaacgattcgcagttaatcctggccttttagagacatcagaaggctgtagacaaatactgggacagctacaaccatcccttcagacaggatcagaagaacttagatcattatataatacaatagcagtcctctattgtgtgcatcaaaggatagatgtaaaagacaccaaggaagccttagataagatagaggaagagcaaaacaaaagtaagaaaaaggcacagcaagcagcagctgacacaggaaacaacagccaggtcagccaaaattaccctatagtgcagaacctccaggggcaaatggtacatcaggccatatcacctagaactttaaatgcatgggtaaaagtagtagaagagaaggctttcagcccagaagtaatacccatgttttcagcattatcagaaggagccaccccacaagatttaaataccatgctaaacacagtggggggacatcaagcagccatgcaaatgttaaaagagaccatcaatgaggaagctgcagaatgggatagattgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattcaacgaatctgccgttgccatatgatccggccatgggttcaaatcgaacccttcatggacggtgtagaaatttgtacagaaatggaaaaggaaggaaaaatttcaaaaattgggcctgaaaatccatacaatactccagtatttgccataaagaaaaaagacagtactaaatggagaaaattagtagatttcagagaacttaataagagaactcaagatttctgggaagttcaattaggaataccacatcctgcagggttaaaacagaaaaaatcagtaacagtactggatgtgggcgatgcatatttttcagttcccttagataaagacttcaggaagtatactgcatttaccatacctagtataaacaatgagacaccagggattagatatcagtacaatgtgcttccacagggatggaaaggatcaccagcaatattccagtgtagcatgacaaaaatcttagagccttttagaaaacaaaatccagacatagtcatctatcaatacatggatgatttgtatgtaggatctgacttagaaatagggcagcatagaacaaaaatagaggaactgagacaacatctgttgaggtggggatttaccacaccagacaaaaaacatcagaaagaacctccattcctttggatgggttatgaactccatcctgataaatggacagtacagcctatagtgctgccagaaaaggacagctggactgtcaatgacatacagaaattagtgggaaaattgaattgggcaagtcagatttatgcagggattaaagtaaggcaattatgtaaacttcttaggggaaccaaagcactaacagaagtagtaccactaacagaagaagcagagctagaactggcagaaaacagggagattctaaaagaaccggtacatggagtgtattatgacccatcaaaagacttaatagcagaaatacagaagcaggggcaaggccaatggacatatcaaatttatcaagagccatttaaaaatctgaaaacaggaaagtatgcaagaatgaacgaatctgccgttgccatatacagcatctgaacaagctgatcgaacccttcatggacggttaaggccgcctgttggtgggcggggatcaagcaggaatttggcattccctacaatccccaaagtcaaggagtaatagaatctatgaataaagaattaaagaaaattataggacaggtaagagatcaggctgaacatcttaagacagcagtacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggaaaggaccagcaaagctcctctggaaaggtgaaggggcagtagtaatacaagataatagtgacataaaagtagtgccaagaagaaaagcaaagatcatcagggattaaccgtccatgaagggttcgattatctgtagccaacattcgatatggcaacggcagattcgttggagatgggggtggaaatggggcaccatgctccttgggatattgatgatctgtagtgctacagaaaaattgtgggtcacagtctattatggggtacctgtgtggaaggaagcaaccaccactctattttgtgcatcagatgctaaagcatatgatacagaggtacataatgtttgggccacacatgcctgtgtacccacagaccccaacccacaagaagtagtattggtaaatgtgacagaaaattttaacatgtggaaaaatgacatggtagaacagatgcatgaggatataatcagtttatgggatcaaagcctaaagccatgtgtaaaattaaccccactctgtgttagtttaaagtgcactgatttgaagaatgatactaataccaatagtagtagcgggagaatgataatggagaaaggagagataaaaaactgctctttcaatatcagcacaagcataagagataaggtgcagaaagaatatgcattcttttataaacttgatatagtaccaatagataataccagctataggttgataagttgtaacacctcagtcattacacaggcctgtccaaaggtatcctttgagccaattcccatacattattgtgccccggctggttttgcgattctaaaatgtaataataagacgttcaatggaacaggaccatgtacaaatgtcagcacagtacaatgtacacatggaatcaggccagtagtatcaactcaactgctgttaaatggcagtctagcagaagaagatgtagtaattagatctgccaatttcacagacaatgctaaaaccataatagtacagctgaacacatctgtagaaattaattgtacaagacccaacaacaatacaagaaaaagtatccgtatccagaggggaccagggagagcatttgttacaataggaaaaataggaaatatgagacaagcacattgtaacattagtagagcaaaatggaatgccactttaaaacagatagctagcaaattaagagaacaatttggaaataataaaacaataatctttaagcaatcctcaggaggggacccagaaattgtaacgcacagttttaattgtggaggggaatttttctactgtaattcaacacaactgtttaatagtacttggtttaatagtacttggagtactgaagggtcaaataacactgaaggaagtgacacaatcacactcccatgcagaataaaacaatttataaacatgtggcaggaagtaggaaaagcaatgtatgcccctcccatcagtggacaaattagatgttcatcaaatattactgggctgctattaacaagagatggtggtaataacaacaatgggtccgagatcttcagacctggaggaggcgatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctgatatagtgcagcagcagaacaatttgctgagggctattgaggcgcaacagcatctgttgcaactcacagtctggggcatcaaacagctccaggcaagaatcctggctgtggaaagatacctaaaggatcaacagctcctggggatttggggttgctctggaaaactcatttgcaccactgctgtgccttggaatgctagttggagtaataaatctctggaacagatttggaataacatgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaatcccgaggggacccgacaggcccgaaggaatagaagaagaaggtggagagagagacagagacagatccattcgattagtgaacggatccttagcacttatctgggacgatctgcggagcctgtgcctcttcagctaccaccgcttgagagacttactcttgattgtaacgaggattgtggaacttctgggacgcagggggtgggaagccctcaaatattggtggaatctcctacagtattggagtcaggaactaaagaatagtgctgttaacttgctcaatgccacagccatagcagtagctgaggggacagatagggttatagaagtattacaagcagcttatagagctattcgccacatacctagaagaataagacagggcttggaaaggattttgctataagatgggtggcaagtggtcaaaaagtagtgtgattggatggcctgctgtaagggaaagaatgagacgagctgagccagcagcagatggggtgggagcagtatctcgagacctagaaaaacatggagcaatcacaagtagcaatacagcagctaacaatgctgcttgtgcctggctagaagcacaagaggaggaagaggtgggttttccagtcacacctcaggtacctttaagaccaatgacttacaaggcagctgtagatcttagccactttttaaaagaaaaggggggactggaagggctaattcactcccaaagaagacaagatatccttgatctgtggatctaccacacacaaggctacttccctgattggcagaactacacaccagggccaggggtcagatatccactgacctttggatggtgctacaagctagtaccagttgagccagataaggtagaagaggccaataaaggagagaacaccagcttgttacaccctgtgagcctgcatggaatggatgaccctgagagagaagtgttagagtggaggtttgacagccgcctagcatttcatcacgtggcccgagagctgcatccggagtacttcaagaactgctgacatcgagcttgctacaagggactttccgctggggactttccagggaggcgtggcctgggcgggactggggagtggcgagccctcagatgctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagca

SEQ ID NO: 82 - DNA, 8411 bp, Artificial Sequence
  Synthetic Sequence
tggaagggctaatttggtcccaaaaaagacaagagatccttgatctgtggatctaccacacacaaggctacttccctgattggcagaactacacaccagggccagggatcagatatccactgacctttggatggtgcttcaagttagtaccagttgaaccagagcaagtagaagaggccaatgaaggagagaacaacagcttgttacaccctatgagccagcatgggatggaggacccggagggagaagtattagtgtggaagtttgacagcctcctagcatttcgtcacatggcccgagagctgcatccggagtactacaaagactgctgacatcgagctttctacaagggactttccgctggggactttccagggaggtgtggcctgggcgggactggggagtggcgagccctcagatgctacatataagcagctgctttttgcctgtactgggtctctctggttagaccagatctgagcctgggagctctctggctaactagggaacccactgcttaagcctcaataaagcttgccttgagtgctcaaagtagtgtgtgcccgtctgttgtgtgactctggtaactagagatccctcagacccttttagtcagtgtggaaaatctctagcagtggcgcccgaacagggacttgaaagcgaaagtaaagccagaggagatctctcgacgcaggactcggcttgctgaagcgcgcacggcaagaggcgaggggcggcgactggtgagtacgccaaaaattttgactagcggaggctagaaggagagagatgggtgcgagagcgtcggtattaagcgggggagaattagataaatgggaaaaaattcggttaaggccagggggaaagaaacaatataaactaaaacatatagtatgggcaagcagggagctagaacgattcgcagttaatcctggccttttagagacatcagaaggctgtagacaaatactgggacagctacaaccatcccttcagacaggatcagaagaacttagatcattatataatacaatagcagtcctctattgtgtgcatcaaaggatagatgtaaaagacaccaaggaagccttagataagatagaggaagagcaaaacaaaagtaagaaaaaggcacagcaagcagcagctgacacaggaaacaacagccaggtcagccaaaattaccctatagtgcagaacctccaggggcaaatggtacatcaggccatatcacctagaactttaaatgcatgggtaaaagtagtagaagagaaggctttcagcccagaagtaatacccatgttttcagcattatcagaaggagccaccccacaagatttaaataccatgctaaacacagtggggggacatcaagcagccatgcaaatgttaaaagagaccatcaatgaggaagctgcagaatgggatagattgcatccagtgcatgcagggcctaccgtccatgaagggttcgattggacccgcccggacgctcatatggcaacggcagattcgttagttcaattaggaataccacatcctgcagggttaaaacagaaaaaatcagtaacagtactggatgtgggcgatgcatatttttcagttcccttagataaagacttcaggaagtatactgcatttaccatacctagtataaacaatgagacaccagggattagatatcagtacaatgtgcttccacagggatggaaaggatcaccagcaatattccagtgtagcatgacaaaaatcttagagccttttagaaaacaaaatccagacatagtcatctatcaatacatggatgatttgtatgtaggatctgacttagaaatagggcagcatagaacaaaaatagaggaactgagacaacatctgttgaggtggggatttaccacaccagacaaaaaacatcagaaagaacctccattcctttggatgggttatgaactccatcctgataaatggacagtacagcctatagtgctgccagaaaaggacagctggactgtcaatgacatacagaaattagtgggaaaattgaattgggcaagtcagatttatgcagggattaaagtaaggcaattatgtaaacttcttaggggaaccaaagcactaacagaagtagtaccactaacagaagaagcagagctagaactggcagaaaacagggagattctaaaagaaccggtacatggagtgtattatgacccatcaaaagacttaatagcagaaatacagaagcaggggcaaggccaatggacatatcaaatttatcaagagccatttaaaaatctgaaaacaggaaagtatgcaagaatgaagggtgcccacactaatgatgtgaaacaattaacagaggcagtacaaaaaatagccacagaaagcatagtaatatggggaaagactcctaaatttaaattacccatacaaaaggaaacatgggaagcatggtggacagagtattggcaagccacctggattcctgagtgggagtttgtcaatacccctcccttagtgaagttatggtaccagttagagaaagaacccataataggagcagaaactttctatgtagatggggcagccaatagggaaactaaattaggaaaagcaggatatgtaactgacagaggaagacaaaaagttgtccccctaacggacacaacaaatcagaagactgagttacaagcaattcatctagctttgcaggattcgggattagaagtaaacatagtgacagactcacaatatgcattgggaatcattcaagcacaaccagataagagtgaatcagagttagtcagtcaaataatagagcagttaataaaaaaggaaaaagtctacctggcatgggtaccagcacacaaaggaattggaggaaatgaacaagtagataaattggtcagtgctggaatcaggaaagtactatttttagatggaatagataaggcccaagaagaacatgagaaatatcacagtaattggagagcaatggctagtgattttaacctaccacctgtagtagcaaaagaaatagtagccagctgtgataaatgtcagctaaaaggggaagccatgcatggacaagtagactgtagcccaggaatatggcagctagattgtacacatttagaaggaaaagttatcttggtagcagttcatgtagccagtggatatatagaagcagaagtaattccagcagagacagggcaagaaacagcatacttcctcttaaaattagcaggaagatggccagtaaaaacagtacatacagacaatggcagcaatttcaccagtactacagttaaggccgcctgttggtgggcggggatcaagcaggaatttggcattccctacaatccccaaagtcaaggagtaatagaatctatgaataaagaattaaagaaaattataggacaggtaagagatcaggctgaacatcttaagacagcagtacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggaaaggaccagcaaagctcctctggaaaggtgaaggggcagtagtaatacaagataatagtgacataaaagtagtgccaagaagaaaagcaaagatcatcagggattatggaaaacagatggcaggtgatgattgtgtggcaagtagacaggatgaggattaacacatggaaaagattagtaaaacaccatatgtatatttcaaggaaagctaaggactggttttatagacatcactatgaaagtactaatccaaaaataagttcagaagtacacatcccactaggggatgctaaattagtaataacaacatattggggtctgcatacaggagaaagagactggcatttgggtcagggagtctccatagaatggaggaaaaagagatatagcacacaagtagaccctgacctagcagaccaactaattcatctgcactattttgattgtttttcagaatctgctataagaaataccatattaggacgtatagttagtcctaggtgtgaatatcaagcaggacataacaaggtaggatctctacagtacttggcactagcagcattaataaaaccaaaacagataaagccacctttgcctagtgttaggaaactgacagaggacagatggaacaagccccagaagaccaagggccacagagggagccatacaatgaatggacactagagcttttagaggaacttaagagtgaagctgttagacattttcctaggatatggctccataacttaggacaacatatctatgaaacttacggggatacttgggcaggagtggaagccataataagaattctgcaacaactgctgtttatccatttcagaattgggtgtcgacatagcagaataggcgttactcgacagaggagagcaagaaatggagccagtagatcctagactagagccctggaagcatccaggaagtcagcctaaaactgcttgtaccaattgctattgtaaaaagtgttgctttcattgccaagtttgtttcatgacaaaagccttaggcatctcctatggcaggaagaagcggagacagcgacgaagagctcatcagaacagtcagactcatcaagcttctctatcaaagcagtaagtagtacatgtaatgcaacctataatagtagcaatagtagcattagtagtagcaataataatagcaatagttgtgtggtccatagtaatcatagaatataggaaaatattaagacaaagaaaaatagacaggttaattgatagactaatagaaagagcagaagacagtggcaatgagagtgaaggagaagtatcagcacttgtggagatgggggtggaaatggggcaccatgctccttgggatattgatgatctgtagtgctacagaaaaattgtgggtcacagtctattatggggtacctgtgtggaaggaagcaaccaccactctattttgtgcatcagatgctaaagcatatgatacagaggtacataatgtttgggccacacatgcctgtgtacccacagaccccaacccacaagaagtagtattggtaaatgtgacagaaaattttaacatgtggaaaaatgacatggtagaacagatgcatgaggatataatcagtttatgggatcaaagcctaaagccatgtgtaaaattaaccccactctgtgttagtttaaagtgcactgatttgaagaatgatactaataccaatagtagtagcgggagaatgataatggagaaaggagagataaaaaactgctctttcaatatcagcacaagcataagagataaggtgcagaaagaatatgcattcttttataaacttgatatagtaccaatagataataccagctataggttgataagttgtaacacctcagtcattacacaggcctgtccaaaggtatcctttgagccaattcccatacattattgtgccccggctggttttgcgattctaaaatgtaataataagacgttcaatggaacaggaccatgtacaaatgtcagcacagtacaatgtacacatggaatcaggccagtagtatcaactcaactgctgttaaatggcagtctagcagaagaagatgtagtaattagatctgccaatttcacagacaatgctaaaaccataatagtacagctgaacacatctgtagaaattaattgtacaagacccaacaacaatacaagaaaaagtatccgtatccagaggggaccagggagagcatttgttacaataggaaaaataggaaatatgagacaagcacattgtaacattagtagagcaaaatggaatgccactttaaaacagatagctagcaaattaagagaacaatttggaaataataaaacaataatctttaagcaatcctcaggaggggacccagaaattgtaacgcacagttttaattgtggaggggaatttttctactgtaattcaacacaactgtttaatagtacttggtttaatagtacttggagtactgaagggtcaaataacactgaaggaagtgacacaatcacactcccatgcagaataaaacaatttataaacatgtggcaggaagtaggaaaagcaatgtatgcccctcccatcagtggacaaattagatgttcatcaaatattactgggctgctattaacaagagatggtggtaataacaacaatgggtccgagatcttcagacctggaggaggcgatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctgatatagtgcagcagcagaacaatttgctgagggctattgaggcgcaacagcatctgttgcaactcacagtctggggcatcaaacagctccaggcaagaatcctggctgtggaaagatacctaaaggatcaacagctcctggggatttggggttgctctggaaaactcatttgcaccactgctgtgccttggaatgctagttggagtaataaatctctggaacagatttggaataacatgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaatcccgaggggacccgacaggcccgaaggaatagaagaagaaggtggagagagagacagagacagatccattcgattagtgaacggatccttagcacttatctgggacgatctgcggagcctgtgcctcttcagctaccaccgcttgagagacttactcttgattgtaacgaggattgtggaacttctgggacgcagggggtgggaagccctcaaatattggtggaatctcctacagtattggagtcaggaactaaagaatagtgctgttaacttgctcaatgccacagccatagcagtagctgaggggacagatagggttatagaagtattacaagcagcttatagagctattcgccacatacctagaagaataagacagggcttggaaaggattttgctataagatgggtggcaagtggtcaaaaagtagtgtgattggatggcctgctgtaagggaaagaatgagacgagctgagccagcagcagatggggtgggagcagtatctcgagacctagaaaaacatggagcaatcacaagtagcaatacagcagctaacaatgctgcttgtgcctggctagaagcacaagaggaggaagaggtgggttttccagtcacacctcaggtacctttaagaccaatgacttacaaggcagctgtagatcttagccactttttaaaagaaaaggggggactggaagggctaattcactcccaaagaagacaagatatccttgatctgtggatctaccacacacaaggctacttccctgattggcagaactacacaccagggccaggggtcagatatccactgacctttggatggtgctacaagctagtaccagttgagccagataaggtagaagaggccaataaaggagagaacaccagcttgttacaccctgtgagcctgcatggaatggatgaccctgagagagaagtgttagagtggaggtttgacagccgcctagcatttcatcacgtggcccgagagctgcatccggagtacttcaagaactgctgacatcgagcttgctacaagggactttccgctggggactttccagggaggcgtggcctgggcgggactggggagtggcgagccctcagatgctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagca

SEQ ID NO: 83 - DNA, 7488 bp, Artificial Sequence
  Synthetic Sequence
tggaagggctaatttggtcccaaaaaagacaagagatccttgatctgtggatctaccacacacaaggctacttccctgattggcagaactacacaccagggccagggatcagatatccactgacctttggatggtgcttcaagttagtaccagttgaaccagagcaagtagaagaggccaatgaaggagagaacaacagcttgttacaccctatgagccagcatgggatggaggacccggagggagaagtattagtgtggaagtttgacagcctcctagcatttcgtcacatggcccgagagctgcatccggagtactacaaagactgctgacatcgagctttctacaagggactttccgctggggactttccagggaggtgtggcctgggcgggactggggagtggcgagccctcagatgctacatataagcagctgctttttgcctgtactgggtctctctggttagaccagatctgagcctgggagctctctggctaactagggaacccactgcttaagcctcaataaagcttgccttgagtgctcaaagtagtgtgtgcccgtctgttgtgtgactctggtaactagagatccctcagacccttttagtcagtgtggaaaatctctagcagtggcgcccgaacagggacttgaaagcgaaagtaaagccagaggagatctctcgacgcaggactcggcttgctgaagcgcgcacggcaagaggcgaggggcggcgactggtgagtacgccaaaaattttgactagcggaggctagaaggagagagatgggtgcgagagcgtcggtattaagcgggggagaattagataaatgggaaaaaattcggttaaggccagggggaaagaaacaatataaactaaaacatatagtatgggcaagcagggagctagaacgattcgcagttaatcctggccttttagagacatcagaaggctgtagacaaatactgggacagctacaaccatcccttcagacaggatcagaagaacttagatcattatataatacaatagcagtcctctattgtgtgcatcaaaggatagatgtaaaagacaccaaggaagccttagataagatagaggaagagcaaaacaaaagtaagaaaaaggcacagcaagcagcagctgacacaggaaacaacagccaggtcagccaaaattaccctatagtgcagaacctccaggggcaaatggtacatcaggccatatcacctagaactttaaatgcatgggtaaaagtagtagaagagaaggctttcagcccagaagtaatacccatgttttcagcattatcagaaggagccaccccacaagatttaaataccatgctaaacacagtggggggacatcaagcagccatgcaaatgttaaaagagaccatcaatgaggaagctgcagaatgggatagattgcatccagtgcatgcagggcctaccgtccatgaagggttcgattggacccgcccggacgctcatatggcaacggcagattcgttagttcaattaggaataccacatcctgcagggttaaaacagaaaaaatcagtaacagtactggatgtgggcgatgcatatttttcagttcccttagataaagacttcaggaagtatactgcatttaccatacctagtataaacaatgagacaccagggattagatatcagtacaatgtgcttccacagggatggaaaggatcaccagcaatattccagtgtagcatgacaaaaatcttagagccttttagaaaacaaaatccagacatagtcatctatcaatacatggatgatttgtatgtaggatctgacttagaaatagggcagcatagaacaaaaatagaggaactgagacaacatctgttgaggtggggatttaccacaccagacaaaaaacatcagaaagaacctccattcctttggatgggttatgaactccatcctgataaatggacagtacagcctatagtgctgccagaaaaggacagctggactgtcaatgacatacagaaattagtgggaaaattgaattgggcaagtcagatttatgcagggattaaagtaaggcaattatgtaaacttcttaggggaaccaaagcactaacagaagtagtaccactaacagaagaagcagagctagaactggcagaaaacagggagattctaaaagaaccggtacatggagtgtattatgacccatcaaaagacttaatagcagaaatacagaagcaggggcaaggccaatggacatatcaaatttatcaagagccatttaaaaatctgaaaacaggaaagtatgcaagaatgaagggtgcccacactaatgatgtgaaacaattaacagaggcagtacaaaaaatagccacagaaagcatagtaatatggggaaagactcctaaatttaaattacccatacaaaaggaaacatgggaagcatggtggacagagtattggcaagccacctggattcctgagtgggagtttgtcaatacccctcccttagtgaagttatggtaccagttagagaaagaacccataataggagcagaaactttctatgtagatggggcagccaatagggaaactaaattaggaaaagcaggatatgtaactgacagaggaagacaaaaagttgtccccctaacggacacaacaaatcagaagactgagttacaagcaattcatctagctttgcaggattcgggattagaagtaaacatagtgacagactcacaatatgcattgggaatcattcaagcacaaccagataagagtgaatcagagttagtcagtcaaataatagagcagttaataaaaaaggaaaaagtctacctggcatgggtaccagcacacaaaggaattggaggaaatgaacaagtagataaattggtcagtgctggaatcaggaaagtactatttttagatggaatagataaggcccaagaagaacatgagaaatatcacagtaattggagagcaatggctagtgattttaacctaccacctgtagtagcaaaagaaatagtagccagctgtgataaatgtcagctaaaaggggaagccatgcatggacaagtagactgtagcccaggaatatggcagctagattgtacacatttagaaggaaaagttatcttggtagcagttcatgtagccagtggatatatagaagcagaagtaattccagcagagacagggcaagaaacagcatacttcctcttaaaattagcaggaagatggccagtaaaaacagtacatacagacaatggcagcaatttcaccagtactacagttaaggccgcctgttggtgggcggggatcaagcaggaatttggcattccctacaatccccaaagtcaaggagtaatagaatctatgaataaagaattaaagaaaattataggacaggtaagagatcaggctgaacatcttaagacagcagtacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggaaaggaccagcaaagctcctctggaaaggtgaaggggcagtagtaatacaagataatagtgacataaaagtagtgccaagaagaaaagcaaagatcatcagggattatggaaaacagatggcaggtgatgattgtgtggcccgtccatgaagggttcgattcttgaacagcgcggtctgttatggcaacggcagattcgtttaatgcaacctataatagtagcaatagtagcattagtagtagcaataataatagcaatagttgtgtggtccatagtaatcatagaatataggaaaatattaagacaaagaaaaatagacaggttaattgatagactaatagaaagagcagaagacagtggcaatgagagtgaaggagaagtatcagcacttgtggagatgggggtggaaatggggcaccatgctccttgggatattgatgatctgtagtgctacagaaaaattgtgggtcacagtctattatggggtacctgtgtggaaggaagcaaccaccactctattttgtgcatcagatgctaaagcatatgatacagaggtacataatgtttgggccacacatgcctgtgtacccacagaccccaacccacaagaagtagtattggtaaatgtgacagaaaattttaacatgtggaaaaatgacatggtagaacagatgcatgaggatataatcagtttatgggatcaaagcctaaagccatgtgtaaaattaaccccactctgtgttagtttaaagtgcactgatttgaagaatgatactaataccaatagtagtagcgggagaatgataatggagaaaggagagataaaaaactgctctttcaatatcagcacaagcataagagataaggtgcagaaagaatatgcattcttttataaacttgatatagtaccaatagataataccagctataggttgataagttgtaacacctcagtcattacacaggcctgtccaaaggtatcctttgagccaattcccatacattattgtgccccggctggttttgcgattctaaaatgtaataataagacgttcaatggaacaggaccatgtacaaatgtcagcacagtacaatgtacacatggaatcaggccagtagtatcaactcaactgctgttaaatggcagtctagcagaagaagatgtagtaattagatctgccaatttcacagacaatgctaaaaccataatagtacagctgaacacatctgtagaaattaattgtacaagacccaacaacaatacaagaaaaagtatccgtatccagaggggaccagggagagcatttgttacaataggaaaaataggaaatatgagacaagcacattgtaacattagtagagcaaaatggaatgccactttaaaacagatagctagcaaattaagagaacaatttggaaataataaaacaataatctttaagcaatcctcaggaggggacccagaaattgtaacgcacagttttaattgtggaggggaatttttctactgtaattcaacacaactgtttaatagtacttggtttaatagtacttggagtactgaagggtcaaataacactgaaggaagtgacacaatcacactcccatgcagaataaaacaatttataaacatgtggcaggaagtaggaaaagcaatgtatgcccctcccatcagtggacaaattagatgttcatcaaatattactgggctgctattaacaagagatggtggtaataacaacaatgggtccgagatcttcagacctggaggaggcgatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctgatatagtgcagcagcagaacaatttgctgagggctattgaggcgcaacagcatctgttgcaactcacagtctggggcatcaaacagctccaggcaagaatcctggctgtggaaagatacctaaaggatcaacagctcctggggatttggggttgctctggaaaactcatttgcaccactgctgtgccttggaatgctagttggagtaataaatctctggaacagatttggaataacatgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaatcccgaggggacccgacaggcccgaaggaatagaagaagaaggtggagagagagacagagacagatccattcgattagtgaacggatccttagcacttatctgggacgatctgcggagcctgtgcctcttcagctaccaccgcttgagagacttactcttgattgtaacgaggattgtggaacttctgggacgcagggggtgggaagccctcaaatattggtggaatctcctacagtattggagtcaggaactaaagaatagtgctgttaacttgctcaatgccacagccatagcagtagctgaggggacagatagggttatagaagtattacaagcagcttatagagctattcgccacatacctagaagaataagacagggcttggaaaggattttgctataagatgggtggcaagtggtcaaaaagtagtgtgattggatggcctgctgtaagggaaagaatgagacgagctgagccagcagcagatggggtgggagcagtatctcgagacctagaaaaacatggagcaatcacaagtagcaatacagcagctaacaatgctgcttgtgcctggctagaagcacaagaggaggaagaggtgggttttccagtcacacctcaggtacctttaagaccaatgacttacaaggcagctgtagatcttagccactttttaaaagaaaaggggggactggaagggctaattcactcccaaagaagacaagatatccttgatctgtggatctaccacacacaaggctacttccctgattggcagaactacacaccagggccaggggtcagatatccactgacctttggatggtgctacaagctagtaccagttgagccagataaggtagaagaggccaataaaggagagaacaccagcttgttacaccctgtgagcctgcatggaatggatgaccctgagagagaagtgttagagtggaggtttgacagccgcctagcatttcatcacgtggcccgagagctgcatccggagtacttcaagaactgctgacatcgagcttgctacaagggactttccgctggggactttccagggaggcgtggcctgggcgggactggggagtggcgagccctcagatgctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagca

SEQ ID NO: 84 - DNA, 7263 bp, Artificial Sequence
  Synthetic Sequence
tggaagggctaatttggtcccaaaaaagacaagagatccttgatctgtggatctaccacacacaaggctacttccctgattggcagaactacacaccagggccagggatcagatatccactgacctttggatggtgcttcaagttagtaccagttgaaccagagcaagtagaagaggccaatgaaggagagaacaacagcttgttacaccctatgagccagcatgggatggaggacccggagggagaagtattagtgtggaagtttgacagcctcctagcatttcgtcacatggcccgagagctgcatccggagtactacaaagactgctgacatcgagctttctacaagggactttccgctggggactttccagggaggtgtggcctgggcgggactggggagtggcgagccctcagatgctacatataagcagctgctttttgcctgtactgggtctctctggttagaccagatctgagcctgggagctctctggctaactagggaacccactgcttaagcctcaataaagcttgccttgagtgctcaaagtagtgtgtgcccgtctgttgtgtgactctggtaactagagatccctcagacccttttagtcagtgtggaaaatctctagcagtggcgcccgaacagggacttgaaagcgaaagtaaagccagaggagatctctcgacgcaggactcggcttgctgaagcgcgcacggcaagaggcgaggggcggcgactggtgagtacgccaaaaattttgactagcggaggctagaaggagagagatgggtgcgagagcgtcggtattaagcgggggagaattagataaatgggaaaaaattcggttaaggccagggggaaagaaacaatataaactaaaacatatagtatgggcaagcagggagctagaacgattcgcagttaatcctggccttttagagacatcagaaggctgtagacaaatactgggacagctacaaccatcccttcagacaggatcagaagaacttagatcattatataatacaatagcagtcctctattgtgtgcatcaaaggatagatgtaaaagacaccaaggaagccttagataagatagaggaagagcaaaacaaaagtaagaaaaaggcacagcaagcagcagctgacacaggaaacaacagccaggtcagccaaaattaccctatagtgcagaacctccaggggcaaatggtacatcaggccatatcacctagaactttaaatgcatgggtaaaagtagtagaagagaaggctttcagcccagaagtaatacccatgttttcagcattatcagaaggagccaccccacaagatttaaataccatgctaaacacagtggggggacatcaagcagccatgcaaatgttaaaagagaccatcaatgaggaagctgcagaatgggatagattgcatccagtgcatgcagggcctaccgtccatgaagggttcgattggacccgcccggacgctcatatggcaacggcagattcgttagttcaattaggaataccacatcctgcagggttaaaacagaaaaaatcagtaacagtactggatgtgggcgatgcatatttttcagttcccttagataaagacttcaggaagtatactgcatttaccatacctagtataaacaatgagacaccagggattagatatcagtacaatgtgcttccacagggatggaaaggatcaccagcaatattccagtgtagcatgacaaaaatcttagagccttttagaaaacaaaatccagacatagtcatctatcaatacatggatgatttgtatgtaggatctgacttagaaatagggcagcatagaacaaaaatagaggaactgagacaacatctgttgaggtggggatttaccacaccagacaaaaaacatcagaaagaacctccattcctttggatgggttatgaactccatcctgataaatggacagtacagcctatagtgctgccagaaaaggacagctggactgtcaatgacatacagaaattagtgggaaaattgaattgggcaagtcagatttatgcagggattaaagtaaggcaattatgtaaacttcttaggggaaccaaagcactaacagaagtagtaccactaacagaagaagcagagctagaactggcagaaaacagggagattctaaaagaaccggtacatggagtgtattatgacccatcaaaagacttaatagcagaaatacagaagcaggggcaaggccaatggacatatcaaatttatcaagagccatttaaaaatctgaaaacaggaaagtatgcaagaatgaagggtgcccacactaatgatgtgaaacaattaacagaggcagtacaaaaaatagccacagaaagcatagtaatatggggaaagactcctaaatttaaattacccatacaaaaggaaacatgggaagcatggtggacagagtattggcaagccacctggattcctgagtgggagtttgtcaatacccctcccttagtgaagttatggtaccagttagagaaagaacccataataggagcagaaactttctatgtagatggggcagccaatagggaaactaaattaggaaaagcaggatatgtaactgacagaggaagacaaaaagttgtccccctaacggacacaacaaatcagaagactgagttacaagcaattcatctagctttgcaggattcgggattagaagtaaacatagtgacagactcacaatatgcattgggaatcattcaagcacaaccagataagagtgaatcagagttagtcagtcaaataatagagcagttaataaaaaaggaaaaagtctacctggcatgggtaccagcacacaaaggaattggaggaaatgaacaagtagataaattggtcagtgctggaatcaggaaagtactatttttagatggaatagataaggcccaagaagaacatgagaaatatcacagtaattggagagcaatggctagtgattttaacctaccacctgtagtagcaaaagaaatagtagccagctgtgataaatgtcagctaaaaggggaagccatgcatggacaagtagactgtagcccaggaatatggcagctagattgtacacatttagaaggaaaagttatcttggtagcagttcatgtagccagtggatatatagaagcagaagtaattccagcagagacagggcaagaaacagcatacttcctcttaaaattagcaggaagatggccagtaaaaacagtacatacagacaatggcagcaatttcaccagtactacagttaaggccgcctgttggtgggcggggatcaagcaggaatttggcattccctacaatccccaaagtcaaggagtaatagaatctatgaataaagaattaaagaaaattataggacaggtaagagatcaggctgaacatcttaagacagcagtacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggaaaggaccagcaaagctcctctggaaaggtgaaggggcagtagtaatacaagataatagtgacataaaagtagtgccaagaagaaaagcaaagatcatcagggattaaccgtccatgaagggttcgattatctgtagccaacattcgatatggcaacggcagattcgttggagatgggggtggaaatggggcaccatgctccttgggatattgatgatctgtagtgctacagaaaaattgtgggtcacagtctattatggggtacctgtgtggaaggaagcaaccaccactctattttgtgcatcagatgctaaagcatatgatacagaggtacataatgtttgggccacacatgcctgtgtacccacagaccccaacccacaagaagtagtattggtaaatgtgacagaaaattttaacatgtggaaaaatgacatggtagaacagatgcatgaggatataatcagtttatgggatcaaagcctaaagccatgtgtaaaattaaccccactctgtgttagtttaaagtgcactgatttgaagaatgatactaataccaatagtagtagcgggagaatgataatggagaaaggagagataaaaaactgctctttcaatatcagcacaagcataagagataaggtgcagaaagaatatgcattcttttataaacttgatatagtaccaatagataataccagctataggttgataagttgtaacacctcagtcattacacaggcctgtccaaaggtatcctttgagccaattcccatacattattgtgccccggctggttttgcgattctaaaatgtaataataagacgttcaatggaacaggaccatgtacaaatgtcagcacagtacaatgtacacatggaatcaggccagtagtatcaactcaactgctgttaaatggcagtctagcagaagaagatgtagtaattagatctgccaatttcacagacaatgctaaaaccataatagtacagctgaacacatctgtagaaattaattgtacaagacccaacaacaatacaagaaaaagtatccgtatccagaggggaccagggagagcatttgttacaataggaaaaataggaaatatgagacaagcacattgtaacattagtagagcaaaatggaatgccactttaaaacagatagctagcaaattaagagaacaatttggaaataataaaacaataatctttaagcaatcctcaggaggggacccagaaattgtaacgcacagttttaattgtggaggggaatttttctactgtaattcaacacaactgtttaatagtacttggtttaatagtacttggagtactgaagggtcaaataacactgaaggaagtgacacaatcacactcccatgcagaataaaacaatttataaacatgtggcaggaagtaggaaaagcaatgtatgcccctcccatcagtggacaaattagatgttcatcaaatattactgggctgctattaacaagagatggtggtaataacaacaatgggtccgagatcttcagacctggaggaggcgatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctgatatagtgcagcagcagaacaatttgctgagggctattgaggcgcaacagcatctgttgcaactcacagtctggggcatcaaacagctccaggcaagaatcctggctgtggaaagatacctaaaggatcaacagctcctggggatttggggttgctctggaaaactcatttgcaccactgctgtgccttggaatgctagttggagtaataaatctctggaacagatttggaataacatgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaatcccgaggggacccgacaggcccgaaggaatagaagaagaaggtggagagagagacagagacagatccattcgattagtgaacggatccttagcacttatctgggacgatctgcggagcctgtgcctcttcagctaccaccgcttgagagacttactcttgattgtaacgaggattgtggaacttctgggacgcagggggtgggaagccctcaaatattggtggaatctcctacagtattggagtcaggaactaaagaatagtgctgttaacttgctcaatgccacagccatagcagtagctgaggggacagatagggttatagaagtattacaagcagcttatagagctattcgccacatacctagaagaataagacagggcttggaaaggattttgctataagatgggtggcaagtggtcaaaaagtagtgtgattggatggcctgctgtaagggaaagaatgagacgagctgagccagcagcagatggggtgggagcagtatctcgagacctagaaaaacatggagcaatcacaagtagcaatacagcagctaacaatgctgcttgtgcctggctagaagcacaagaggaggaagaggtgggttttccagtcacacctcaggtacctttaagaccaatgacttacaaggcagctgtagatcttagccactttttaaaagaaaaggggggactggaagggctaattcactcccaaagaagacaagatatccttgatctgtggatctaccacacacaaggctacttccctgattggcagaactacacaccagggccaggggtcagatatccactgacctttggatggtgctacaagctagtaccagttgagccagataaggtagaagaggccaataaaggagagaacaccagcttgttacaccctgtgagcctgcatggaatggatgaccctgagagagaagtgttagagtggaggtttgacagccgcctagcatttcatcacgtggcccgagagctgcatccggagtacttcaagaactgctgacatcgagcttgctacaagggactttccgctggggactttccagggaggcgtggcctgggcgggactggggagtggcgagccctcagatgctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagca

SEQ ID NO: 85 - DNA, 7487 bp, Artificial Sequence
  Synthetic Sequence
tggaagggctaatttggtcccaaaaaagacaagagatccttgatctgtggatctaccacacacaaggctacttccctgattggcagaactacacaccagggccagggatcagatatccactgacctttggatggtgcttcaagttagtaccagttgaaccagagcaagtagaagaggccaatgaaggagagaacaacagcttgttacaccctatgagccagcatgggatggaggacccggagggagaagtattagtgtggaagtttgacagcctcctagcatttcgtcacatggcccgagagctgcatccggagtactacaaagactgctgacatcgagctttctacaagggactttccgctggggactttccagggaggtgtggcctgggcgggactggggagtggcgagccctcagatgctacatataagcagctgctttttgcctgtactgggtctctctggttagaccagatctgagcctgggagctctctggctaactagggaacccactgcttaagcctcaataaagcttgccttgagtgctcaaagtagtgtgtgcccgtctgttgtgtgactctggtaactagagatccctcagacccttttagtcagtgtggaaaatctctagcagtggcgcccgaacagggacttgaaagcgaaagtaaagccagaggagatctctcgacgcaggactcggcttgctgaagcgcgcacggcaagaggcgaggggcggcgactggtgagtacgccaaaaattttgactagcggaggctagaaggagagagatgggtgcgagagcgtcggtattaagcgggggagaattagataaatgggaaaaaattcggttaaggccagggggaaagaaacaatataaactaaaacatatagtatgggcaagcagggagctagaacgattcgcagttaatcctggccttttagagacatcagaaggctgtagacaaatactgggacagctacaaccatcccttcagacaggatcagaagaacttagatcattatataatacaatagcagtcctctattgtgtgcatcaaaggatagatgtaaaagacaccaaggaagccttagataagatagaggaagagcaaaacaaaagtaagaaaaaggcacagcaagcagcagctgacacaggaaacaacagccaggtcagccaaaattaccctatagtgcagaacctccaggggcaaatggtacatcaggccatatcacctagaactttaaatgcatgggtaaaagtagtagaagagaaggctttcagcccagaagtaatacccatgttttcagcattatcagaaggagccaccccacaagatttaaataccatgctaaacacagtggggggacatcaagcagccatgcaaatgttaaaagagaccatcaatgaggaagctgcagaatgggatagattgcatccagtgcatgcagggcctaccgtccatgaagggttcgattggacccgcccggacgctcatatggcaacggcagattcgttagttcaattaggaataccacatcctgcagggttaaaacagaaaaaatcagtaacagtactggatgtgggcgatgcatatttttcagttcccttagataaagacttcaggaagtatactgcatttaccatacctagtataaacaatgagacaccagggattagatatcagtacaatgtgcttccacagggatggaaaggatcaccagcaatattccagtgtagcatgacaaaaatcttagagccttttagaaaacaaaatccagacatagtcatctatcaatacatggatgatttgtatgtaggatctgacttagaaatagggcagcatagaacaaaaatagaggaactgagacaacatctgttgaggtggggatttaccacaccagacaaaaaacatcagaaagaacctccattcctttggatgggttatgaactccatcctgataaatggacagtacagcctatagtgctgccagaaaaggacagctggactgtcaatgacatacagaaattagtgggaaaattgaattgggcaagtcagatttatgcagggattaaagtaaggcaattatgtaaacttcttaggggaaccaaagcactaacagaagtagtaccactaacagaagaagcagagctagaactggcagaaaacagggagattctaaaagaaccggtacatggagtgtattatgacccatcaaaagacttaatagcagaaatacagaagcaggggcaaggccaatggacatatcaaatttatcaagagccatttaaaaatctgaaaacaggaaagtatgcaagaatgaacgaatctgccgttgccatatacagcatctgaacaagctgatcgaacccttcatggacggttaaggccgcctgttggtgggcggggatcaagcaggaatttggcattccctacaatccccaaagtcaaggagtaatagaatctatgaataaagaattaaagaaaattataggacaggtaagagatcaggctgaacatcttaagacagcagtacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggaaaggaccagcaaagctcctctggaaaggtgaaggggcagtagtaatacaagataatagtgacataaaagtagtgccaagaagaaaagcaaagatcatcagggattatggaaaacagatggcaggtgatgattgtgtggcaagtagacaggatgaggattaacacatggaaaagattagtaaaacaccatatgtatatttcaaggaaagctaaggactggttttatagacatcactatgaaagtactaatccaaaaataagttcagaagtacacatcccactaggggatgctaaattagtaataacaacatattggggtctgcatacaggagaaagagactggcatttgggtcagggagtctccatagaatggaggaaaaagagatatagcacacaagtagaccctgacctagcagaccaactaattcatctgcactattttgattgtttttcagaatctgctataagaaataccatattaggacgtatagttagtcctaggtgtgaatatcaagcaggacataacaaggtaggatctctacagtacttggcactagcagcattaataaaaccaaaacagataaagccacctttgcctagtgttaggaaactgacagaggacagatggaacaagccccagaagaccaagggccacagagggagccatacaatgaatggacactagagcttttagaggaacttaagagtgaagctgttagacattttcctaggatatggctccataacttaggacaacatatctatgaaacttacggggatacttgggcaggagtggaagccataataagaattctgcaacaactgctgtttatccatttcagaattgggtgtcgacatagcagaataggcgttactcgacagaggagagcaagaaatggagccagtagatcctagactagagccctggaagcatccaggaagtcagcctaaaactgcttgtaccaattgctattgtaaaaagtgttgctttcattgccaagtttgtttcatgacaaaagccttaggcatctcctatggcaggaagaagcggagacagcgacgaagagctcatcagaacagtcagactcatcaagcttctctatcaaagcagtaagtagtacatgtaatgcaacctataatagtagcaatagtagcattagtagtagcaataataatagcaatagttgtgtggtccatagtaatcatagaatataggaaaatattaagacaaagaaaaatagacaggttaattgatagactaatagaaagagcagaagacagtggcaatgagagtgaaggagaagtatcagcacttgtggagatgggggtggaaatggggcaccatgctccttgggatattgatgatctgtagtgctacagaaaaattgtgggtcacagtctattatggggtacctgtgtggaaggaagcaaccaccactctattttgtgcatcagatgctaaagcatatgatacagaggtacataatgtttgggccacacatgcctgtgtacccacagaccccaacccacaagaagtagtattggtaaatgtgacagaaaattttaacatgtggaaaaatgacatggtagaacagatgcatgaggatataatcagtttatgggatcaaagcctaaagccatgtgtaaaattaaccccactctgtgttagtttaaagtgcactgatttgaagaatgatactaataccaatagtagtagcgggagaatgataatggagaaaggagagataaaaaactgctctttcaatatcagcacaagcataagagataaggtgcagaaagaatatgcattcttttataaacttgatatagtaccaatagataataccagctataggttgataagttgtaacacctcagtcattacacaggcctgtccaaaggtatcctttgagccaattcccatacattattgtgccccggctggttttgcgattctaaaatgtaataataagacgttcaatggaacaggaccatgtacaaatgtcagcacagtacaatgtacacatggaatcaggccagtagtatcaactcaactgctgttaaatggcagtctagcagaagaagatgtagtaattagatctgccaatttcacagacaatgctaaaaccataatagtacagctgaacacatctgtagaaattaattgtacaagacccaacaacaatacaagaaaaagtatccgtatccagaggggaccagggagagcatttgttacaataggaaaaataggaaatatgagacaagcacattgtaacattagtagagcaaaatggaatgccactttaaaacagatagctagcaaattaagagaacaatttggaaataataaaacaataatctttaagcaatcctcaggaggggacccagaaattgtaacgcacagttttaattgtggaggggaatttttctactgtaattcaacacaactgtttaatagtacttggtttaatagtacttggagtactgaagggtcaaataacactgaaggaagtgacacaatcacactcccatgcagaataaaacaatttataaacatgtggcaggaagtaggaaaagcaatgtatgcccctcccatcagtggacaaattagatgttcatcaaatattactgggctgctattaacaagagatggtggtaataacaacaatgggtccgagatcttcagacctggaggaggcgatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctgatatagtgcagcagcagaacaatttgctgagggctattgaggcgcaacagcatctgttgcaactcacagtctggggcatcaaacagctccaggcaagaatcctggctgtggaaagatacctaaaggatcaacagctcctggggatttggggttgctctggaaaactcatttgcaccactgctgtgccttggaatgctagttggagtaataaatctctggaacagatttggaataacatgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaatcccgaggggacccgacaggcccgaaggaatagaagaagaaggtggagagagagacagagacagatccattcgattagtgaacggatccttagcacttatctgggacgatctgcggagcctgtgcctcttcagctaccaccgcttgagagacttactcttgattgtaacgaggattgtggaacttctgggacgcagggggtgggaagccctcaaatattggtggaatctcctacagtattggagtcaggaactaaagaatagtgctgttaacttgctcaatgccacagccatagcagtagctgaggggacagatagggttatagaagtattacaagcagcttatagagctattcgccacatacctagaagaataagacagggcttggaaaggattttgctataagatgggtggcaagtggtcaaaaagtagtgtgattggatggcctgctgtaagggaaagaatgagacgagctgagccagcagcagatggggtgggagcagtatctcgagacctagaaaaacatggagcaatcacaagtagcaatacagcagctaacaatgctgcttgtgcctggctagaagcacaagaggaggaagaggtgggttttccagtcacacctcaggtacctttaagaccaatgacttacaaggcagctgtagatcttagccactttttaaaagaaaaggggggactggaagggctaattcactcccaaagaagacaagatatccttgatctgtggatctaccacacacaaggctacttccctgattggcagaactacacaccagggccaggggtcagatatccactgacctttggatggtgctacaagctagtaccagttgagccagataaggtagaagaggccaataaaggagagaacaccagcttgttacaccctgtgagcctgcatggaatggatgaccctgagagagaagtgttagagtggaggtttgacagccgcctagcatttcatcacgtggcccgagagctgcatccggagtacttcaagaactgctgacatcgagcttgctacaagggactttccgctggggactttccagggaggcgtggcctgggcgggactggggagtggcgagccctcagatgctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagca

SEQ ID NO: 86 - DNA, 6564 bp, Artificial Sequence
  Synthetic Sequence
tggaagggctaatttggtcccaaaaaagacaagagatccttgatctgtggatctaccacacacaaggctacttccctgattggcagaactacacaccagggccagggatcagatatccactgacctttggatggtgcttcaagttagtaccagttgaaccagagcaagtagaagaggccaatgaaggagagaacaacagcttgttacaccctatgagccagcatgggatggaggacccggagggagaagtattagtgtggaagtttgacagcctcctagcatttcgtcacatggcccgagagctgcatccggagtactacaaagactgctgacatcgagctttctacaagggactttccgctggggactttccagggaggtgtggcctgggcgggactggggagtggcgagccctcagatgctacatataagcagctgctttttgcctgtactgggtctctctggttagaccagatctgagcctgggagctctctggctaactagggaacccactgcttaagcctcaataaagcttgccttgagtgctcaaagtagtgtgtgcccgtctgttgtgtgactctggtaactagagatccctcagacccttttagtcagtgtggaaaatctctagcagtggcgcccgaacagggacttgaaagcgaaagtaaagccagaggagatctctcgacgcaggactcggcttgctgaagcgcgcacggcaagaggcgaggggcggcgactggtgagtacgccaaaaattttgactagcggaggctagaaggagagagatgggtgcgagagcgtcggtattaagcgggggagaattagataaatgggaaaaaattcggttaaggccagggggaaagaaacaatataaactaaaacatatagtatgggcaagcagggagctagaacgattcgcagttaatcctggccttttagagacatcagaaggctgtagacaaatactgggacagctacaaccatcccttcagacaggatcagaagaacttagatcattatataatacaatagcagtcctctattgtgtgcatcaaaggatagatgtaaaagacaccaaggaagccttagataagatagaggaagagcaaaacaaaagtaagaaaaaggcacagcaagcagcagctgacacaggaaacaacagccaggtcagccaaaattaccctatagtgcagaacctccaggggcaaatggtacatcaggccatatcacctagaactttaaatgcatgggtaaaagtagtagaagagaaggctttcagcccagaagtaatacccatgttttcagcattatcagaaggagccaccccacaagatttaaataccatgctaaacacagtggggggacatcaagcagccatgcaaatgttaaaagagaccatcaatgaggaagctgcagaatgggatagattgcatccagtgcatgcagggcctaccgtccatgaagggttcgattggacccgcccggacgctcatatggcaacggcagattcgttagttcaattaggaataccacatcctgcagggttaaaacagaaaaaatcagtaacagtactggatgtgggcgatgcatatttttcagttcccttagataaagacttcaggaagtatactgcatttaccatacctagtataaacaatgagacaccagggattagatatcagtacaatgtgcttccacagggatggaaaggatcaccagcaatattccagtgtagcatgacaaaaatcttagagccttttagaaaacaaaatccagacatagtcatctatcaatacatggatgatttgtatgtaggatctgacttagaaatagggcagcatagaacaaaaatagaggaactgagacaacatctgttgaggtggggatttaccacaccagacaaaaaacatcagaaagaacctccattcctttggatgggttatgaactccatcctgataaatggacagtacagcctatagtgctgccagaaaaggacagctggactgtcaatgacatacagaaattagtgggaaaattgaattgggcaagtcagatttatgcagggattaaagtaaggcaattatgtaaacttcttaggggaaccaaagcactaacagaagtagtaccactaacagaagaagcagagctagaactggcagaaaacagggagattctaaaagaaccggtacatggagtgtattatgacccatcaaaagacttaatagcagaaatacagaagcaggggcaaggccaatggacatatcaaatttatcaagagccatttaaaaatctgaaaacaggaaagtatgcaagaatgaacgaatctgccgttgccatatacagcatctgaacaagctgatcgaacccttcatggacggttaaggccgcctgttggtgggcggggatcaagcaggaatttggcattccctacaatccccaaagtcaaggagtaatagaatctatgaataaagaattaaagaaaattataggacaggtaagagatcaggctgaacatcttaagacagcagtacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggaaaggaccagcaaagctcctctggaaaggtgaaggggcagtagtaatacaagataatagtgacataaaagtagtgccaagaagaaaagcaaagatcatcagggattatggaaaacagatggcaggtgatgattgtgtggcccgtccatgaagggttcgattcttgaacagcgcggtctgttatggcaacggcagattcgtttaatgcaacctataatagtagcaatagtagcattagtagtagcaataataatagcaatagttgtgtggtccatagtaatcatagaatataggaaaatattaagacaaagaaaaatagacaggttaattgatagactaatagaaagagcagaagacagtggcaatgagagtgaaggagaagtatcagcacttgtggagatgggggtggaaatggggcaccatgctccttgggatattgatgatctgtagtgctacagaaaaattgtgggtcacagtctattatggggtacctgtgtggaaggaagcaaccaccactctattttgtgcatcagatgctaaagcatatgatacagaggtacataatgtttgggccacacatgcctgtgtacccacagaccccaacccacaagaagtagtattggtaaatgtgacagaaaattttaacatgtggaaaaatgacatggtagaacagatgcatgaggatataatcagtttatgggatcaaagcctaaagccatgtgtaaaattaaccccactctgtgttagtttaaagtgcactgatttgaagaatgatactaataccaatagtagtagcgggagaatgataatggagaaaggagagataaaaaactgctctttcaatatcagcacaagcataagagataaggtgcagaaagaatatgcattcttttataaacttgatatagtaccaatagataataccagctataggttgataagttgtaacacctcagtcattacacaggcctgtccaaaggtatcctttgagccaattcccatacattattgtgccccggctggttttgcgattctaaaatgtaataataagacgttcaatggaacaggaccatgtacaaatgtcagcacagtacaatgtacacatggaatcaggccagtagtatcaactcaactgctgttaaatggcagtctagcagaagaagatgtagtaattagatctgccaatttcacagacaatgctaaaaccataatagtacagctgaacacatctgtagaaattaattgtacaagacccaacaacaatacaagaaaaagtatccgtatccagaggggaccagggagagcatttgttacaataggaaaaataggaaatatgagacaagcacattgtaacattagtagagcaaaatggaatgccactttaaaacagatagctagcaaattaagagaacaatttggaaataataaaacaataatctttaagcaatcctcaggaggggacccagaaattgtaacgcacagttttaattgtggaggggaatttttctactgtaattcaacacaactgtttaatagtacttggtttaatagtacttggagtactgaagggtcaaataacactgaaggaagtgacacaatcacactcccatgcagaataaaacaatttataaacatgtggcaggaagtaggaaaagcaatgtatgcccctcccatcagtggacaaattagatgttcatcaaatattactgggctgctattaacaagagatggtggtaataacaacaatgggtccgagatcttcagacctggaggaggcgatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctgatatagtgcagcagcagaacaatttgctgagggctattgaggcgcaacagcatctgttgcaactcacagtctggggcatcaaacagctccaggcaagaatcctggctgtggaaagatacctaaaggatcaacagctcctggggatttggggttgctctggaaaactcatttgcaccactgctgtgccttggaatgctagttggagtaataaatctctggaacagatttggaataacatgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaatcccgaggggacccgacaggcccgaaggaatagaagaagaaggtggagagagagacagagacagatccattcgattagtgaacggatccttagcacttatctgggacgatctgcggagcctgtgcctcttcagctaccaccgcttgagagacttactcttgattgtaacgaggattgtggaacttctgggacgcagggggtgggaagccctcaaatattggtggaatctcctacagtattggagtcaggaactaaagaatagtgctgttaacttgctcaatgccacagccatagcagtagctgaggggacagatagggttatagaagtattacaagcagcttatagagctattcgccacatacctagaagaataagacagggcttggaaaggattttgctataagatgggtggcaagtggtcaaaaagtagtgtgattggatggcctgctgtaagggaaagaatgagacgagctgagccagcagcagatggggtgggagcagtatctcgagacctagaaaaacatggagcaatcacaagtagcaatacagcagctaacaatgctgcttgtgcctggctagaagcacaagaggaggaagaggtgggttttccagtcacacctcaggtacctttaagaccaatgacttacaaggcagctgtagatcttagccactttttaaaagaaaaggggggactggaagggctaattcactcccaaagaagacaagatatccttgatctgtggatctaccacacacaaggctacttccctgattggcagaactacacaccagggccaggggtcagatatccactgacctttggatggtgctacaagctagtaccagttgagccagataaggtagaagaggccaataaaggagagaacaccagcttgttacaccctgtgagcctgcatggaatggatgaccctgagagagaagtgttagagtggaggtttgacagccgcctagcatttcatcacgtggcccgagagctgcatccggagtacttcaagaactgctgacatcgagcttgctacaagggactttccgctggggactttccagggaggcgtggcctgggcgggactggggagtggcgagccctcagatgctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagca

SEQ ID NO: 87 - DNA, 6339 bp, Artificial Sequence
  Synthetic Sequence
tggaagggctaatttggtcccaaaaaagacaagagatccttgatctgtggatctaccacacacaaggctacttccctgattggcagaactacacaccagggccagggatcagatatccactgacctttggatggtgcttcaagttagtaccagttgaaccagagcaagtagaagaggccaatgaaggagagaacaacagcttgttacaccctatgagccagcatgggatggaggacccggagggagaagtattagtgtggaagtttgacagcctcctagcatttcgtcacatggcccgagagctgcatccggagtactacaaagactgctgacatcgagctttctacaagggactttccgctggggactttccagggaggtgtggcctgggcgggactggggagtggcgagccctcagatgctacatataagcagctgctttttgcctgtactgggtctctctggttagaccagatctgagcctgggagctctctggctaactagggaacccactgcttaagcctcaataaagcttgccttgagtgctcaaagtagtgtgtgcccgtctgttgtgtgactctggtaactagagatccctcagacccttttagtcagtgtggaaaatctctagcagtggcgcccgaacagggacttgaaagcgaaagtaaagccagaggagatctctcgacgcaggactcggcttgctgaagcgcgcacggcaagaggcgaggggcggcgactggtgagtacgccaaaaattttgactagcggaggctagaaggagagagatgggtgcgagagcgtcggtattaagcgggggagaattagataaatgggaaaaaattcggttaaggccagggggaaagaaacaatataaactaaaacatatagtatgggcaagcagggagctagaacgattcgcagttaatcctggccttttagagacatcagaaggctgtagacaaatactgggacagctacaaccatcccttcagacaggatcagaagaacttagatcattatataatacaatagcagtcctctattgtgtgcatcaaaggatagatgtaaaagacaccaaggaagccttagataagatagaggaagagcaaaacaaaagtaagaaaaaggcacagcaagcagcagctgacacaggaaacaacagccaggtcagccaaaattaccctatagtgcagaacctccaggggcaaatggtacatcaggccatatcacctagaactttaaatgcatgggtaaaagtagtagaagagaaggctttcagcccagaagtaatacccatgttttcagcattatcagaaggagccaccccacaagatttaaataccatgctaaacacagtggggggacatcaagcagccatgcaaatgttaaaagagaccatcaatgaggaagctgcagaatgggatagattgcatccagtgcatgcagggcctaccgtccatgaagggttcgattggacccgcccggacgctcatatggcaacggcagattcgttagttcaattaggaataccacatcctgcagggttaaaacagaaaaaatcagtaacagtactggatgtgggcgatgcatatttttcagttcccttagataaagacttcaggaagtatactgcatttaccatacctagtataaacaatgagacaccagggattagatatcagtacaatgtgcttccacagggatggaaaggatcaccagcaatattccagtgtagcatgacaaaaatcttagagccttttagaaaacaaaatccagacatagtcatctatcaatacatggatgatttgtatgtaggatctgacttagaaatagggcagcatagaacaaaaatagaggaactgagacaacatctgttgaggtggggatttaccacaccagacaaaaaacatcagaaagaacctccattcctttggatgggttatgaactccatcctgataaatggacagtacagcctatagtgctgccagaaaaggacagctggactgtcaatgacatacagaaattagtgggaaaattgaattgggcaagtcagatttatgcagggattaaagtaaggcaattatgtaaacttcttaggggaaccaaagcactaacagaagtagtaccactaacagaagaagcagagctagaactggcagaaaacagggagattctaaaagaaccggtacatggagtgtattatgacccatcaaaagacttaatagcagaaatacagaagcaggggcaaggccaatggacatatcaaatttatcaagagccatttaaaaatctgaaaacaggaaagtatgcaagaatgaacgaatctgccgttgccatatacagcatctgaacaagctgatcgaacccttcatggacggttaaggccgcctgttggtgggcggggatcaagcaggaatttggcattccctacaatccccaaagtcaaggagtaatagaatctatgaataaagaattaaagaaaattataggacaggtaagagatcaggctgaacatcttaagacagcagtacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggaaaggaccagcaaagctcctctggaaaggtgaaggggcagtagtaatacaagataatagtgacataaaagtagtgccaagaagaaaagcaaagatcatcagggattaaccgtccatgaagggttcgattatctgtagccaacattcgatatggcaacggcagattcgttggagatgggggtggaaatggggcaccatgctccttgggatattgatgatctgtagtgctacagaaaaattgtgggtcacagtctattatggggtacctgtgtggaaggaagcaaccaccactctattttgtgcatcagatgctaaagcatatgatacagaggtacataatgtttgggccacacatgcctgtgtacccacagaccccaacccacaagaagtagtattggtaaatgtgacagaaaattttaacatgtggaaaaatgacatggtagaacagatgcatgaggatataatcagtttatgggatcaaagcctaaagccatgtgtaaaattaaccccactctgtgttagtttaaagtgcactgatttgaagaatgatactaataccaatagtagtagcgggagaatgataatggagaaaggagagataaaaaactgctctttcaatatcagcacaagcataagagataaggtgcagaaagaatatgcattcttttataaacttgatatagtaccaatagataataccagctataggttgataagttgtaacacctcagtcattacacaggcctgtccaaaggtatcctttgagccaattcccatacattattgtgccccggctggttttgcgattctaaaatgtaataataagacgttcaatggaacaggaccatgtacaaatgtcagcacagtacaatgtacacatggaatcaggccagtagtatcaactcaactgctgttaaatggcagtctagcagaagaagatgtagtaattagatctgccaatttcacagacaatgctaaaaccataatagtacagctgaacacatctgtagaaattaattgtacaagacccaacaacaatacaagaaaaagtatccgtatccagaggggaccagggagagcatttgttacaataggaaaaataggaaatatgagacaagcacattgtaacattagtagagcaaaatggaatgccactttaaaacagatagctagcaaattaagagaacaatttggaaataataaaacaataatctttaagcaatcctcaggaggggacccagaaattgtaacgcacagttttaattgtggaggggaatttttctactgtaattcaacacaactgtttaatagtacttggtttaatagtacttggagtactgaagggtcaaataacactgaaggaagtgacacaatcacactcccatgcagaataaaacaatttataaacatgtggcaggaagtaggaaaagcaatgtatgcccctcccatcagtggacaaattagatgttcatcaaatattactgggctgctattaacaagagatggtggtaataacaacaatgggtccgagatcttcagacctggaggaggcgatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctgatatagtgcagcagcagaacaatttgctgagggctattgaggcgcaacagcatctgttgcaactcacagtctggggcatcaaacagctccaggcaagaatcctggctgtggaaagatacctaaaggatcaacagctcctggggatttggggttgctctggaaaactcatttgcaccactgctgtgccttggaatgctagttggagtaataaatctctggaacagatttggaataacatgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaatcccgaggggacccgacaggcccgaaggaatagaagaagaaggtggagagagagacagagacagatccattcgattagtgaacggatccttagcacttatctgggacgatctgcggagcctgtgcctcttcagctaccaccgcttgagagacttactcttgattgtaacgaggattgtggaacttctgggacgcagggggtgggaagccctcaaatattggtggaatctcctacagtattggagtcaggaactaaagaatagtgctgttaacttgctcaatgccacagccatagcagtagctgaggggacagatagggttatagaagtattacaagcagcttatagagctattcgccacatacctagaagaataagacagggcttggaaaggattttgctataagatgggtggcaagtggtcaaaaagtagtgtgattggatggcctgctgtaagggaaagaatgagacgagctgagccagcagcagatggggtgggagcagtatctcgagacctagaaaaacatggagcaatcacaagtagcaatacagcagctaacaatgctgcttgtgcctggctagaagcacaagaggaggaagaggtgggttttccagtcacacctcaggtacctttaagaccaatgacttacaaggcagctgtagatcttagccactttttaaaagaaaaggggggactggaagggctaattcactcccaaagaagacaagatatccttgatctgtggatctaccacacacaaggctacttccctgattggcagaactacacaccagggccaggggtcagatatccactgacctttggatggtgctacaagctagtaccagttgagccagataaggtagaagaggccaataaaggagagaacaccagcttgttacaccctgtgagcctgcatggaatggatgaccctgagagagaagtgttagagtggaggtttgacagccgcctagcatttcatcacgtggcccgagagctgcatccggagtacttcaagaactgctgacatcgagcttgctacaagggactttccgctggggactttccagggaggcgtggcctgggcgggactggggagtggcgagccctcagatgctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagca

SEQ ID NO: 88 - DNA, 8225 bp, Artificial Sequence
  Synthetic Sequence
tggaagggctaatttggtcccaaaaaagacaagagatccttgatctgtggatctaccacacacaaggctacttccctgattggcagaactacacaccagggccagggatcagatatccactgacctttggatggtgcttcaagttagtaccagttgaaccagagcaagtagaagaggccaatgaaggagagaacaacagcttgttacaccctatgagccagcatgggatggaggacccggagggagaagtattagtgtggaagtttgacagcctcctagcatttcgtcacatggcccgagagctgcatccggagtactacaaagactgctgacatcgagctttctacaagggactttccgctggggactttccagggaggtgtggcctgggcgggactggggagtggcgagccctcagatgctacatataagcagctgctttttgcctgtactgggtctctctggttagaccagatctgagcctgggagctctctggctaactagggaacccactgcttaagcctcaataaagcttgccttgagtgctcaaagtagtgtgtgcccgtctgttgtgtgactctggtaactagagatccctcagacccttttagtcagtgtggaaaatctctagcagtggcgcccgaacagggacttgaaagcgaaagtaaagccagaggagatctctcgacgcaggactcggcttgctgaagcgcgcacggcaagaggcgaggggcggcgactggtgagtacgccaaaaattttgactagcggaggctagaaggagagagatgggtgcgagagcgtcggtattaagcgggggagaattagataaatgggaaaaaattcggttaaggccagggggaaagaaacaatataaactaaaacatatagtatgggcaagcagggagctagaacgattcgcagttaatcctggccttttagagacatcagaaggctgtagacaaatactgggacagctacaaccatcccttcagacaggatcagaagaacttagatcattatataatacaatagcagtcctctattgtgtgcatcaaaggatagatgtaaaagacaccaaggaagccttagataagatagaggaagagcaaaacaaaagtaagaaaaaggcacagcaagcagcagctgacacaggaaacaacagccaggtcagccaaaattaccctatagtgcagaacctccaggggcaaatggtacatcaggccatatcacctagaactttaaatgcatgggtaaaagtagtagaagagaaggctttcagcccagaagtaatacccatgttttcagcattatcagaaggagccaccccacaagatttaaataccatgctaaacacagtggggggacatcaagcagccatgcaaatgttaaaagagaccatcaatgaggaagctgcagaatgggatagattgcatccagtgcatgcaccgtccatgaagggttcgatcaggcagctcaagaaacacgtatggcaacggcagattcgttttccacagggatggaaaggatcaccagcaatattccagtgtagcatgacaaaaatcttagagccttttagaaaacaaaatccagacatagtcatctatcaatacatggatgatttgtatgtaggatctgacttagaaatagggcagcatagaacaaaaatagaggaactgagacaacatctgttgaggtggggatttaccacaccagacaaaaaacatcagaaagaacctccattcctttggatgggttatgaactccatcctgataaatggacagtacagcctatagtgctgccagaaaaggacagctggactgtcaatgacatacagaaattagtgggaaaattgaattgggcaagtcagatttatgcagggattaaagtaaggcaattatgtaaacttcttaggggaaccaaagcactaacagaagtagtaccactaacagaagaagcagagctagaactggcagaaaacagggagattctaaaagaaccggtacatggagtgtattatgacccatcaaaagacttaatagcagaaatacagaagcaggggcaaggccaatggacatatcaaatttatcaagagccatttaaaaatctgaaaacaggaaagtatgcaagaatgaagggtgcccacactaatgatgtgaaacaattaacagaggcagtacaaaaaatagccacagaaagcatagtaatatggggaaagactcctaaatttaaattacccatacaaaaggaaacatgggaagcatggtggacagagtattggcaagccacctggattcctgagtgggagtttgtcaatacccctcccttagtgaagttatggtaccagttagagaaagaacccataataggagcagaaactttctatgtagatggggcagccaatagggaaactaaattaggaaaagcaggatatgtaactgacagaggaagacaaaaagttgtccccctaacggacacaacaaatcagaagactgagttacaagcaattcatctagctttgcaggattcgggattagaagtaaacatagtgacagactcacaatatgcattgggaatcattcaagcacaaccagataagagtgaatcagagttagtcagtcaaataatagagcagttaataaaaaaggaaaaagtctacctggcatgggtaccagcacacaaaggaattggaggaaatgaacaagtagataaattggtcagtgctggaatcaggaaagtactatttttagatggaatagataaggcccaagaagaacatgagaaatatcacagtaattggagagcaatggctagtgattttaacctaccacctgtagtagcaaaagaaatagtagccagctgtgataaatgtcagctaaaaggggaagccatgcatggacaagtagactgtagcccaggaatatggcagctagattgtacacatttagaaggaaaagttatcttggtagcagttcatgtagccagtggatatatagaagcagaagtaattccagcagagacagggcaagaaacagcatacttcctcttaaaattagcaggaagatggccagtaaaaacagtacatacagacaatggcagcaatttcaccagtactacagttaaggccgcctgttggtgggcggggatcaagcaggaatttggcattccctacaatccccaaagtcaaggagtaatagaatctatgaataaagaattaaagaaaattataggacaggtaagagatcaggctgaacatcttaagacagcagtacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggaaaggaccagcaaagctcctctggaaaggtgaaggggcagtagtaatacaagataatagtgacataaaagtagtgccaagaagaaaagcaaagatcatcagggattatggaaaacagatggcaggtgatgattgtgtggcaagtagacaggatgaggattaacacatggaaaagattagtaaaacaccatatgtatatttcaaggaaagctaaggactggttttatagacatcactatgaaagtactaatccaaaaataagttcagaagtacacatcccactaggggatgctaaattagtaataacaacatattggggtctgcatacaggagaaagagactggcatttgggtcagggagtctccatagaatggaggaaaaagagatatagcacacaagtagaccctgacctagcagaccaactaattcatctgcactattttgattgtttttcagaatctgctataagaaataccatattaggacgtatagttagtcctaggtgtgaatatcaagcaggacataacaaggtaggatctctacagtacttggcactagcagcattaataaaaccaaaacagataaagccacctttgcctagtgttaggaaactgacagaggacagatggaacaagccccagaagaccaagggccacagagggagccatacaatgaatggacactagagcttttagaggaacttaagagtgaagctgttagacattttcctaggatatggctccataacttaggacaacatatctatgaaacttacggggatacttgggcaggagtggaagccataataagaattctgcaacaactgctgtttatccatttcagaattgggtgtcgacatagcagaataggcgttactcgacagaggagagcaagaaatggagccagtagatcctagactagagccctggaagcatccaggaagtcagcctaaaactgcttgtaccaattgctattgtaaaaagtgttgctttcattgccaagtttgtttcatgacaaaagccttaggcatctcctatggcaggaagaagcggagacagcgacgaagagctcatcagaacagtcagactcatcaagcttctctatcaaagcagtaagtagtacatgtaatgcaacctataatagtagcaatagtagcattagtagtagcaataataatagcaatagttgtgtggtccatagtaatcatagaatataggaaaatattaagacaaagaaaaatagacaggttaattgatagactaatagaaagagcagaagacagtggcaatgagagtgaaggagaagtatcagcacttgtggagatgggggtggaaatggggcaccatgctccttgggatattgatgatctgtagtgctacagaaaaattgtgggtcacagtctattatggggtacctgtgtggaaggaagcaaccaccactctattttgtgcatcagatgctaaagcatatgatacagaggtacataatgtttgggccacacatgcctgtgtacccacagaccccaacccacaagaagtagtattggtaaatgtgacagaaaattttaacatgtggaaaaatgacatggtagaacagatgcatgaggatataatcagtttatgggatcaaagcctaaagccatgtgtaaaattaaccccactctgtgttagtttaaagtgcactgatttgaagaatgatactaataccaatagtagtagcgggagaatgataatggagaaaggagagataaaaaactgctctttcaatatcagcacaagcataagagataaggtgcagaaagaatatgcattcttttataaacttgatatagtaccaatagataataccagctataggttgataagttgtaacacctcagtcattacacaggcctgtccaaaggtatcctttgagccaattcccatacattattgtgccccggctggttttgcgattctaaaatgtaataataagacgttcaatggaacaggaccatgtacaaatgtcagcacagtacaatgtacacatggaatcaggccagtagtatcaactcaactgctgttaaatggcagtctagcagaagaagatgtagtaattagatctgccaatttcacagacaatgctaaaaccataatagtacagctgaacacatctgtagaaattaattgtacaagacccaacaacaatacaagaaaaagtatccgtatccagaggggaccagggagagcatttgttacaataggaaaaataggaaatatgagacaagcacattgtaacattagtagagcaaaatggaatgccactttaaaacagatagctagcaaattaagagaacaatttggaaataataaaacaataatctttaagcaatcctcaggaggggacccagaaattgtaacgcacagttttaattgtggaggggaatttttctactgtaattcaacacaactgtttaatagtacttggtttaatagtacttggagtactgaagggtcaaataacactgaaggaagtgacacaatcacactcccatgcagaataaaacaatttataaacatgtggcaggaagtaggaaaagcaatgtatgcccctcccatcagtggacaaattagatgttcatcaaatattactgggctgctattaacaagagatggtggtaataacaacaatgggtccgagatcttcagacctggaggaggcgatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctgatatagtgcagcagcagaacaatttgctgagggctattgaggcgcaacagcatctgttgcaactcacagtctggggcatcaaacagctccaggcaagaatcctggctgtggaaagatacctaaaggatcaacagctcctggggatttggggttgctctggaaaactcatttgcaccactgctgtgccttggaatgctagttggagtaataaatctctggaacagatttggaataacatgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaatcccgaggggacccgacaggcccgaaggaatagaagaagaaggtggagagagagacagagacagatccattcgattagtgaacggatccttagcacttatctgggacgatctgcggagcctgtgcctcttcagctaccaccgcttgagagacttactcttgattgtaacgaggattgtggaacttctgggacgcagggggtgggaagccctcaaatattggtggaatctcctacagtattggagtcaggaactaaagaatagtgctgttaacttgctcaatgccacagccatagcagtagctgaggggacagatagggttatagaagtattacaagcagcttatagagctattcgccacatacctagaagaataagacagggcttggaaaggattttgctataagatgggtggcaagtggtcaaaaagtagtgtgattggatggcctgctgtaagggaaagaatgagacgagctgagccagcagcagatggggtgggagcagtatctcgagacctagaaaaacatggagcaatcacaagtagcaatacagcagctaacaatgctgcttgtgcctggctagaagcacaagaggaggaagaggtgggttttccagtcacacctcaggtacctttaagaccaatgacttacaaggcagctgtagatcttagccactttttaaaagaaaaggggggactggaagggctaattcactcccaaagaagacaagatatccttgatctgtggatctaccacacacaaggctacttccctgattggcagaactacacaccagggccaggggtcagatatccactgacctttggatggtgctacaagctagtaccagttgagccagataaggtagaagaggccaataaaggagagaacaccagcttgttacaccctgtgagcctgcatggaatggatgaccctgagagagaagtgttagagtggaggtttgacagccgcctagcatttcatcacgtggcccgagagctgcatccggagtacttcaagaactgctgacatcgagcttgctacaagggactttccgctggggactttccagggaggcgtggcctgggcgggactggggagtggcgagccctcagatgctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagca

SEQ ID NO: 89 - DNA, 7302 bp, Artificial Sequence
  Synthetic Sequence
tggaagggctaatttggtcccaaaaaagacaagagatccttgatctgtggatctaccacacacaaggctacttccctgattggcagaactacacaccagggccagggatcagatatccactgacctttggatggtgcttcaagttagtaccagttgaaccagagcaagtagaagaggccaatgaaggagagaacaacagcttgttacaccctatgagccagcatgggatggaggacccggagggagaagtattagtgtggaagtttgacagcctcctagcatttcgtcacatggcccgagagctgcatccggagtactacaaagactgctgacatcgagctttctacaagggactttccgctggggactttccagggaggtgtggcctgggcgggactggggagtggcgagccctcagatgctacatataagcagctgctttttgcctgtactgggtctctctggttagaccagatctgagcctgggagctctctggctaactagggaacccactgcttaagcctcaataaagcttgccttgagtgctcaaagtagtgtgtgcccgtctgttgtgtgactctggtaactagagatccctcagacccttttagtcagtgtggaaaatctctagcagtggcgcccgaacagggacttgaaagcgaaagtaaagccagaggagatctctcgacgcaggactcggcttgctgaagcgcgcacggcaagaggcgaggggcggcgactggtgagtacgccaaaaattttgactagcggaggctagaaggagagagatgggtgcgagagcgtcggtattaagcgggggagaattagataaatgggaaaaaattcggttaaggccagggggaaagaaacaatataaactaaaacatatagtatgggcaagcagggagctagaacgattcgcagttaatcctggccttttagagacatcagaaggctgtagacaaatactgggacagctacaaccatcccttcagacaggatcagaagaacttagatcattatataatacaatagcagtcctctattgtgtgcatcaaaggatagatgtaaaagacaccaaggaagccttagataagatagaggaagagcaaaacaaaagtaagaaaaaggcacagcaagcagcagctgacacaggaaacaacagccaggtcagccaaaattaccctatagtgcagaacctccaggggcaaatggtacatcaggccatatcacctagaactttaaatgcatgggtaaaagtagtagaagagaaggctttcagcccagaagtaatacccatgttttcagcattatcagaaggagccaccccacaagatttaaataccatgctaaacacagtggggggacatcaagcagccatgcaaatgttaaaagagaccatcaatgaggaagctgcagaatgggatagattgcatccagtgcatgcaccgtccatgaagggttcgatcaggcagctcaagaaacacgtatggcaacggcagattcgttttccacagggatggaaaggatcaccagcaatattccagtgtagcatgacaaaaatcttagagccttttagaaaacaaaatccagacatagtcatctatcaatacatggatgatttgtatgtaggatctgacttagaaatagggcagcatagaacaaaaatagaggaactgagacaacatctgttgaggtggggatttaccacaccagacaaaaaacatcagaaagaacctccattcctttggatgggttatgaactccatcctgataaatggacagtacagcctatagtgctgccagaaaaggacagctggactgtcaatgacatacagaaattagtgggaaaattgaattgggcaagtcagatttatgcagggattaaagtaaggcaattatgtaaacttcttaggggaaccaaagcactaacagaagtagtaccactaacagaagaagcagagctagaactggcagaaaacagggagattctaaaagaaccggtacatggagtgtattatgacccatcaaaagacttaatagcagaaatacagaagcaggggcaaggccaatggacatatcaaatttatcaagagccatttaaaaatctgaaaacaggaaagtatgcaagaatgaagggtgcccacactaatgatgtgaaacaattaacagaggcagtacaaaaaatagccacagaaagcatagtaatatggggaaagactcctaaatttaaattacccatacaaaaggaaacatgggaagcatggtggacagagtattggcaagccacctggattcctgagtgggagtttgtcaatacccctcccttagtgaagttatggtaccagttagagaaagaacccataataggagcagaaactttctatgtagatggggcagccaatagggaaactaaattaggaaaagcaggatatgtaactgacagaggaagacaaaaagttgtccccctaacggacacaacaaatcagaagactgagttacaagcaattcatctagctttgcaggattcgggattagaagtaaacatagtgacagactcacaatatgcattgggaatcattcaagcacaaccagataagagtgaatcagagttagtcagtcaaataatagagcagttaataaaaaaggaaaaagtctacctggcatgggtaccagcacacaaaggaattggaggaaatgaacaagtagataaattggtcagtgctggaatcaggaaagtactatttttagatggaatagataaggcccaagaagaacatgagaaatatcacagtaattggagagcaatggctagtgattttaacctaccacctgtagtagcaaaagaaatagtagccagctgtgataaatgtcagctaaaaggggaagccatgcatggacaagtagactgtagcccaggaatatggcagctagattgtacacatttagaaggaaaagttatcttggtagcagttcatgtagccagtggatatatagaagcagaagtaattccagcagagacagggcaagaaacagcatacttcctcttaaaattagcaggaagatggccagtaaaaacagtacatacagacaatggcagcaatttcaccagtactacagttaaggccgcctgttggtgggcggggatcaagcaggaatttggcattccctacaatccccaaagtcaaggagtaatagaatctatgaataaagaattaaagaaaattataggacaggtaagagatcaggctgaacatcttaagacagcagtacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggaaaggaccagcaaagctcctctggaaaggtgaaggggcagtagtaatacaagataatagtgacataaaagtagtgccaagaagaaaagcaaagatcatcagggattatggaaaacagatggcaggtgatgattgtgtggcccgtccatgaagggttcgattcttgaacagcgcggtctgttatggcaacggcagattcgtttaatgcaacctataatagtagcaatagtagcattagtagtagcaataataatagcaatagttgtgtggtccatagtaatcatagaatataggaaaatattaagacaaagaaaaatagacaggttaattgatagactaatagaaagagcagaagacagtggcaatgagagtgaaggagaagtatcagcacttgtggagatgggggtggaaatggggcaccatgctccttgggatattgatgatctgtagtgctacagaaaaattgtgggtcacagtctattatggggtacctgtgtggaaggaagcaaccaccactctattttgtgcatcagatgctaaagcatatgatacagaggtacataatgtttgggccacacatgcctgtgtacccacagaccccaacccacaagaagtagtattggtaaatgtgacagaaaattttaacatgtggaaaaatgacatggtagaacagatgcatgaggatataatcagtttatgggatcaaagcctaaagccatgtgtaaaattaaccccactctgtgttagtttaaagtgcactgatttgaagaatgatactaataccaatagtagtagcgggagaatgataatggagaaaggagagataaaaaactgctctttcaatatcagcacaagcataagagataaggtgcagaaagaatatgcattcttttataaacttgatatagtaccaatagataataccagctataggttgataagttgtaacacctcagtcattacacaggcctgtccaaaggtatcctttgagccaattcccatacattattgtgccccggctggttttgcgattctaaaatgtaataataagacgttcaatggaacaggaccatgtacaaatgtcagcacagtacaatgtacacatggaatcaggccagtagtatcaactcaactgctgttaaatggcagtctagcagaagaagatgtagtaattagatctgccaatttcacagacaatgctaaaaccataatagtacagctgaacacatctgtagaaattaattgtacaagacccaacaacaatacaagaaaaagtatccgtatccagaggggaccagggagagcatttgttacaataggaaaaataggaaatatgagacaagcacattgtaacattagtagagcaaaatggaatgccactttaaaacagatagctagcaaattaagagaacaatttggaaataataaaacaataatctttaagcaatcctcaggaggggacccagaaattgtaacgcacagttttaattgtggaggggaatttttctactgtaattcaacacaactgtttaatagtacttggtttaatagtacttggagtactgaagggtcaaataacactgaaggaagtgacacaatcacactcccatgcagaataaaacaatttataaacatgtggcaggaagtaggaaaagcaatgtatgcccctcccatcagtggacaaattagatgttcatcaaatattactgggctgctattaacaagagatggtggtaataacaacaatgggtccgagatcttcagacctggaggaggcgatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctgatatagtgcagcagcagaacaatttgctgagggctattgaggcgcaacagcatctgttgcaactcacagtctggggcatcaaacagctccaggcaagaatcctggctgtggaaagatacctaaaggatcaacagctcctggggatttggggttgctctggaaaactcatttgcaccactgctgtgccttggaatgctagttggagtaataaatctctggaacagatttggaataacatgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaatcccgaggggacccgacaggcccgaaggaatagaagaagaaggtggagagagagacagagacagatccattcgattagtgaacggatccttagcacttatctgggacgatctgcggagcctgtgcctcttcagctaccaccgcttgagagacttactcttgattgtaacgaggattgtggaacttctgggacgcagggggtgggaagccctcaaatattggtggaatctcctacagtattggagtcaggaactaaagaatagtgctgttaacttgctcaatgccacagccatagcagtagctgaggggacagatagggttatagaagtattacaagcagcttatagagctattcgccacatacctagaagaataagacagggcttggaaaggattttgctataagatgggtggcaagtggtcaaaaagtagtgtgattggatggcctgctgtaagggaaagaatgagacgagctgagccagcagcagatggggtgggagcagtatctcgagacctagaaaaacatggagcaatcacaagtagcaatacagcagctaacaatgctgcttgtgcctggctagaagcacaagaggaggaagaggtgggttttccagtcacacctcaggtacctttaagaccaatgacttacaaggcagctgtagatcttagccactttttaaaagaaaaggggggactggaagggctaattcactcccaaagaagacaagatatccttgatctgtggatctaccacacacaaggctacttccctgattggcagaactacacaccagggccaggggtcagatatccactgacctttggatggtgctacaagctagtaccagttgagccagataaggtagaagaggccaataaaggagagaacaccagcttgttacaccctgtgagcctgcatggaatggatgaccctgagagagaagtgttagagtggaggtttgacagccgcctagcatttcatcacgtggcccgagagctgcatccggagtacttcaagaactgctgacatcgagcttgctacaagggactttccgctggggactttccagggaggcgtggcctgggcgggactggggagtggcgagccctcagatgctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagca

SEQ ID NO: 90 - DNA, 7077 bp, Artificial Sequence
  Synthetic Sequence
tggaagggctaatttggtcccaaaaaagacaagagatccttgatctgtggatctaccacacacaaggctacttccctgattggcagaactacacaccagggccagggatcagatatccactgacctttggatggtgcttcaagttagtaccagttgaaccagagcaagtagaagaggccaatgaaggagagaacaacagcttgttacaccctatgagccagcatgggatggaggacccggagggagaagtattagtgtggaagtttgacagcctcctagcatttcgtcacatggcccgagagctgcatccggagtactacaaagactgctgacatcgagctttctacaagggactttccgctggggactttccagggaggtgtggcctgggcgggactggggagtggcgagccctcagatgctacatataagcagctgctttttgcctgtactgggtctctctggttagaccagatctgagcctgggagctctctggctaactagggaacccactgcttaagcctcaataaagcttgccttgagtgctcaaagtagtgtgtgcccgtctgttgtgtgactctggtaactagagatccctcagacccttttagtcagtgtggaaaatctctagcagtggcgcccgaacagggacttgaaagcgaaagtaaagccagaggagatctctcgacgcaggactcggcttgctgaagcgcgcacggcaagaggcgaggggcggcgactggtgagtacgccaaaaattttgactagcggaggctagaaggagagagatgggtgcgagagcgtcggtattaagcgggggagaattagataaatgggaaaaaattcggttaaggccagggggaaagaaacaatataaactaaaacatatagtatgggcaagcagggagctagaacgattcgcagttaatcctggccttttagagacatcagaaggctgtagacaaatactgggacagctacaaccatcccttcagacaggatcagaagaacttagatcattatataatacaatagcagtcctctattgtgtgcatcaaaggatagatgtaaaagacaccaaggaagccttagataagatagaggaagagcaaaacaaaagtaagaaaaaggcacagcaagcagcagctgacacaggaaacaacagccaggtcagccaaaattaccctatagtgcagaacctccaggggcaaatggtacatcaggccatatcacctagaactttaaatgcatgggtaaaagtagtagaagagaaggctttcagcccagaagtaatacccatgttttcagcattatcagaaggagccaccccacaagatttaaataccatgctaaacacagtggggggacatcaagcagccatgcaaatgttaaaagagaccatcaatgaggaagctgcagaatgggatagattgcatccagtgcatgcaccgtccatgaagggttcgatcaggcagctcaagaaacacgtatggcaacggcagattcgttttccacagggatggaaaggatcaccagcaatattccagtgtagcatgacaaaaatcttagagccttttagaaaacaaaatccagacatagtcatctatcaatacatggatgatttgtatgtaggatctgacttagaaatagggcagcatagaacaaaaatagaggaactgagacaacatctgttgaggtggggatttaccacaccagacaaaaaacatcagaaagaacctccattcctttggatgggttatgaactccatcctgataaatggacagtacagcctatagtgctgccagaaaaggacagctggactgtcaatgacatacagaaattagtgggaaaattgaattgggcaagtcagatttatgcagggattaaagtaaggcaattatgtaaacttcttaggggaaccaaagcactaacagaagtagtaccactaacagaagaagcagagctagaactggcagaaaacagggagattctaaaagaaccggtacatggagtgtattatgacccatcaaaagacttaatagcagaaatacagaagcaggggcaaggccaatggacatatcaaatttatcaagagccatttaaaaatctgaaaacaggaaagtatgcaagaatgaagggtgcccacactaatgatgtgaaacaattaacagaggcagtacaaaaaatagccacagaaagcatagtaatatggggaaagactcctaaatttaaattacccatacaaaaggaaacatgggaagcatggtggacagagtattggcaagccacctggattcctgagtgggagtttgtcaatacccctcccttagtgaagttatggtaccagttagagaaagaacccataataggagcagaaactttctatgtagatggggcagccaatagggaaactaaattaggaaaagcaggatatgtaactgacagaggaagacaaaaagttgtccccctaacggacacaacaaatcagaagactgagttacaagcaattcatctagctttgcaggattcgggattagaagtaaacatagtgacagactcacaatatgcattgggaatcattcaagcacaaccagataagagtgaatcagagttagtcagtcaaataatagagcagttaataaaaaaggaaaaagtctacctggcatgggtaccagcacacaaaggaattggaggaaatgaacaagtagataaattggtcagtgctggaatcaggaaagtactatttttagatggaatagataaggcccaagaagaacatgagaaatatcacagtaattggagagcaatggctagtgattttaacctaccacctgtagtagcaaaagaaatagtagccagctgtgataaatgtcagctaaaaggggaagccatgcatggacaagtagactgtagcccaggaatatggcagctagattgtacacatttagaaggaaaagttatcttggtagcagttcatgtagccagtggatatatagaagcagaagtaattccagcagagacagggcaagaaacagcatacttcctcttaaaattagcaggaagatggccagtaaaaacagtacatacagacaatggcagcaatttcaccagtactacagttaaggccgcctgttggtgggcggggatcaagcaggaatttggcattccctacaatccccaaagtcaaggagtaatagaatctatgaataaagaattaaagaaaattataggacaggtaagagatcaggctgaacatcttaagacagcagtacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggaaaggaccagcaaagctcctctggaaaggtgaaggggcagtagtaatacaagataatagtgacataaaagtagtgccaagaagaaaagcaaagatcatcagggattaaccgtccatgaagggttcgattatctgtagccaacattcgatatggcaacggcagattcgttggagatgggggtggaaatggggcaccatgctccttgggatattgatgatctgtagtgctacagaaaaattgtgggtcacagtctattatggggtacctgtgtggaaggaagcaaccaccactctattttgtgcatcagatgctaaagcatatgatacagaggtacataatgtttgggccacacatgcctgtgtacccacagaccccaacccacaagaagtagtattggtaaatgtgacagaaaattttaacatgtggaaaaatgacatggtagaacagatgcatgaggatataatcagtttatgggatcaaagcctaaagccatgtgtaaaattaaccccactctgtgttagtttaaagtgcactgatttgaagaatgatactaataccaatagtagtagcgggagaatgataatggagaaaggagagataaaaaactgctctttcaatatcagcacaagcataagagataaggtgcagaaagaatatgcattcttttataaacttgatatagtaccaatagataataccagctataggttgataagttgtaacacctcagtcattacacaggcctgtccaaaggtatcctttgagccaattcccatacattattgtgccccggctggttttgcgattctaaaatgtaataataagacgttcaatggaacaggaccatgtacaaatgtcagcacagtacaatgtacacatggaatcaggccagtagtatcaactcaactgctgttaaatggcagtctagcagaagaagatgtagtaattagatctgccaatttcacagacaatgctaaaaccataatagtacagctgaacacatctgtagaaattaattgtacaagacccaacaacaatacaagaaaaagtatccgtatccagaggggaccagggagagcatttgttacaataggaaaaataggaaatatgagacaagcacattgtaacattagtagagcaaaatggaatgccactttaaaacagatagctagcaaattaagagaacaatttggaaataataaaacaataatctttaagcaatcctcaggaggggacccagaaattgtaacgcacagttttaattgtggaggggaatttttctactgtaattcaacacaactgtttaatagtacttggtttaatagtacttggagtactgaagggtcaaataacactgaaggaagtgacacaatcacactcccatgcagaataaaacaatttataaacatgtggcaggaagtaggaaaagcaatgtatgcccctcccatcagtggacaaattagatgttcatcaaatattactgggctgctattaacaagagatggtggtaataacaacaatgggtccgagatcttcagacctggaggaggcgatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctgatatagtgcagcagcagaacaatttgctgagggctattgaggcgcaacagcatctgttgcaactcacagtctggggcatcaaacagctccaggcaagaatcctggctgtggaaagatacctaaaggatcaacagctcctggggatttggggttgctctggaaaactcatttgcaccactgctgtgccttggaatgctagttggagtaataaatctctggaacagatttggaataacatgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaatcccgaggggacccgacaggcccgaaggaatagaagaagaaggtggagagagagacagagacagatccattcgattagtgaacggatccttagcacttatctgggacgatctgcggagcctgtgcctcttcagctaccaccgcttgagagacttactcttgattgtaacgaggattgtggaacttctgggacgcagggggtgggaagccctcaaatattggtggaatctcctacagtattggagtcaggaactaaagaatagtgctgttaacttgctcaatgccacagccatagcagtagctgaggggacagatagggttatagaagtattacaagcagcttatagagctattcgccacatacctagaagaataagacagggcttggaaaggattttgctataagatgggtggcaagtggtcaaaaagtagtgtgattggatggcctgctgtaagggaaagaatgagacgagctgagccagcagcagatggggtgggagcagtatctcgagacctagaaaaacatggagcaatcacaagtagcaatacagcagctaacaatgctgcttgtgcctggctagaagcacaagaggaggaagaggtgggttttccagtcacacctcaggtacctttaagaccaatgacttacaaggcagctgtagatcttagccactttttaaaagaaaaggggggactggaagggctaattcactcccaaagaagacaagatatccttgatctgtggatctaccacacacaaggctacttccctgattggcagaactacacaccagggccaggggtcagatatccactgacctttggatggtgctacaagctagtaccagttgagccagataaggtagaagaggccaataaaggagagaacaccagcttgttacaccctgtgagcctgcatggaatggatgaccctgagagagaagtgttagagtggaggtttgacagccgcctagcatttcatcacgtggcccgagagctgcatccggagtacttcaagaactgctgacatcgagcttgctacaagggactttccgctggggactttccagggaggcgtggcctgggcgggactggggagtggcgagccctcagatgctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagca

SEQ ID NO: 91 - DNA, 7301 bp, Artificial Sequence
  Synthetic Sequence
tggaagggctaatttggtcccaaaaaagacaagagatccttgatctgtggatctaccacacacaaggctacttccctgattggcagaactacacaccagggccagggatcagatatccactgacctttggatggtgcttcaagttagtaccagttgaaccagagcaagtagaagaggccaatgaaggagagaacaacagcttgttacaccctatgagccagcatgggatggaggacccggagggagaagtattagtgtggaagtttgacagcctcctagcatttcgtcacatggcccgagagctgcatccggagtactacaaagactgctgacatcgagctttctacaagggactttccgctggggactttccagggaggtgtggcctgggcgggactggggagtggcgagccctcagatgctacatataagcagctgctttttgcctgtactgggtctctctggttagaccagatctgagcctgggagctctctggctaactagggaacccactgcttaagcctcaataaagcttgccttgagtgctcaaagtagtgtgtgcccgtctgttgtgtgactctggtaactagagatccctcagacccttttagtcagtgtggaaaatctctagcagtggcgcccgaacagggacttgaaagcgaaagtaaagccagaggagatctctcgacgcaggactcggcttgctgaagcgcgcacggcaagaggcgaggggcggcgactggtgagtacgccaaaaattttgactagcggaggctagaaggagagagatgggtgcgagagcgtcggtattaagcgggggagaattagataaatgggaaaaaattcggttaaggccagggggaaagaaacaatataaactaaaacatatagtatgggcaagcagggagctagaacgattcgcagttaatcctggccttttagagacatcagaaggctgtagacaaatactgggacagctacaaccatcccttcagacaggatcagaagaacttagatcattatataatacaatagcagtcctctattgtgtgcatcaaaggatagatgtaaaagacaccaaggaagccttagataagatagaggaagagcaaaacaaaagtaagaaaaaggcacagcaagcagcagctgacacaggaaacaacagccaggtcagccaaaattaccctatagtgcagaacctccaggggcaaatggtacatcaggccatatcacctagaactttaaatgcatgggtaaaagtagtagaagagaaggctttcagcccagaagtaatacccatgttttcagcattatcagaaggagccaccccacaagatttaaataccatgctaaacacagtggggggacatcaagcagccatgcaaatgttaaaagagaccatcaatgaggaagctgcagaatgggatagattgcatccagtgcatgcaccgtccatgaagggttcgatcaggcagctcaagaaacacgtatggcaacggcagattcgttttccacagggatggaaaggatcaccagcaatattccagtgtagcatgacaaaaatcttagagccttttagaaaacaaaatccagacatagtcatctatcaatacatggatgatttgtatgtaggatctgacttagaaatagggcagcatagaacaaaaatagaggaactgagacaacatctgttgaggtggggatttaccacaccagacaaaaaacatcagaaagaacctccattcctttggatgggttatgaactccatcctgataaatggacagtacagcctatagtgctgccagaaaaggacagctggactgtcaatgacatacagaaattagtgggaaaattgaattgggcaagtcagatttatgcagggattaaagtaaggcaattatgtaaacttcttaggggaaccaaagcactaacagaagtagtaccactaacagaagaagcagagctagaactggcagaaaacagggagattctaaaagaaccggtacatggagtgtattatgacccatcaaaagacttaatagcagaaatacagaagcaggggcaaggccaatggacatatcaaatttatcaagagccatttaaaaatctgaaaacaggaaagtatgcaagaatgaacgaatctgccgttgccatatacagcatctgaacaagctgatcgaacccttcatggacggttaaggccgcctgttggtgggcggggatcaagcaggaatttggcattccctacaatccccaaagtcaaggagtaatagaatctatgaataaagaattaaagaaaattataggacaggtaagagatcaggctgaacatcttaagacagcagtacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggaaaggaccagcaaagctcctctggaaaggtgaaggggcagtagtaatacaagataatagtgacataaaagtagtgccaagaagaaaagcaaagatcatcagggattatggaaaacagatggcaggtgatgattgtgtggcaagtagacaggatgaggattaacacatggaaaagattagtaaaacaccatatgtatatttcaaggaaagctaaggactggttttatagacatcactatgaaagtactaatccaaaaataagttcagaagtacacatcccactaggggatgctaaattagtaataacaacatattggggtctgcatacaggagaaagagactggcatttgggtcagggagtctccatagaatggaggaaaaagagatatagcacacaagtagaccctgacctagcagaccaactaattcatctgcactattttgattgtttttcagaatctgctataagaaataccatattaggacgtatagttagtcctaggtgtgaatatcaagcaggacataacaaggtaggatctctacagtacttggcactagcagcattaataaaaccaaaacagataaagccacctttgcctagtgttaggaaactgacagaggacagatggaacaagccccagaagaccaagggccacagagggagccatacaatgaatggacactagagcttttagaggaacttaagagtgaagctgttagacattttcctaggatatggctccataacttaggacaacatatctatgaaacttacggggatacttgggcaggagtggaagccataataagaattctgcaacaactgctgtttatccatttcagaattgggtgtcgacatagcagaataggcgttactcgacagaggagagcaagaaatggagccagtagatcctagactagagccctggaagcatccaggaagtcagcctaaaactgcttgtaccaattgctattgtaaaaagtgttgctttcattgccaagtttgtttcatgacaaaagccttaggcatctcctatggcaggaagaagcggagacagcgacgaagagctcatcagaacagtcagactcatcaagcttctctatcaaagcagtaagtagtacatgtaatgcaacctataatagtagcaatagtagcattagtagtagcaataataatagcaatagttgtgtggtccatagtaatcatagaatataggaaaatattaagacaaagaaaaatagacaggttaattgatagactaatagaaagagcagaagacagtggcaatgagagtgaaggagaagtatcagcacttgtggagatgggggtggaaatggggcaccatgctccttgggatattgatgatctgtagtgctacagaaaaattgtgggtcacagtctattatggggtacctgtgtggaaggaagcaaccaccactctattttgtgcatcagatgctaaagcatatgatacagaggtacataatgtttgggccacacatgcctgtgtacccacagaccccaacccacaagaagtagtattggtaaatgtgacagaaaattttaacatgtggaaaaatgacatggtagaacagatgcatgaggatataatcagtttatgggatcaaagcctaaagccatgtgtaaaattaaccccactctgtgttagtttaaagtgcactgatttgaagaatgatactaataccaatagtagtagcgggagaatgataatggagaaaggagagataaaaaactgctctttcaatatcagcacaagcataagagataaggtgcagaaagaatatgcattcttttataaacttgatatagtaccaatagataataccagctataggttgataagttgtaacacctcagtcattacacaggcctgtccaaaggtatcctttgagccaattcccatacattattgtgccccggctggttttgcgattctaaaatgtaataataagacgttcaatggaacaggaccatgtacaaatgtcagcacagtacaatgtacacatggaatcaggccagtagtatcaactcaactgctgttaaatggcagtctagcagaagaagatgtagtaattagatctgccaatttcacagacaatgctaaaaccataatagtacagctgaacacatctgtagaaattaattgtacaagacccaacaacaatacaagaaaaagtatccgtatccagaggggaccagggagagcatttgttacaataggaaaaataggaaatatgagacaagcacattgtaacattagtagagcaaaatggaatgccactttaaaacagatagctagcaaattaagagaacaatttggaaataataaaacaataatctttaagcaatcctcaggaggggacccagaaattgtaacgcacagttttaattgtggaggggaatttttctactgtaattcaacacaactgtttaatagtacttggtttaatagtacttggagtactgaagggtcaaataacactgaaggaagtgacacaatcacactcccatgcagaataaaacaatttataaacatgtggcaggaagtaggaaaagcaatgtatgcccctcccatcagtggacaaattagatgttcatcaaatattactgggctgctattaacaagagatggtggtaataacaacaatgggtccgagatcttcagacctggaggaggcgatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctgatatagtgcagcagcagaacaatttgctgagggctattgaggcgcaacagcatctgttgcaactcacagtctggggcatcaaacagctccaggcaagaatcctggctgtggaaagatacctaaaggatcaacagctcctggggatttggggttgctctggaaaactcatttgcaccactgctgtgccttggaatgctagttggagtaataaatctctggaacagatttggaataacatgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaatcccgaggggacccgacaggcccgaaggaatagaagaagaaggtggagagagagacagagacagatccattcgattagtgaacggatccttagcacttatctgggacgatctgcggagcctgtgcctcttcagctaccaccgcttgagagacttactcttgattgtaacgaggattgtggaacttctgggacgcagggggtgggaagccctcaaatattggtggaatctcctacagtattggagtcaggaactaaagaatagtgctgttaacttgctcaatgccacagccatagcagtagctgaggggacagatagggttatagaagtattacaagcagcttatagagctattcgccacatacctagaagaataagacagggcttggaaaggattttgctataagatgggtggcaagtggtcaaaaagtagtgtgattggatggcctgctgtaagggaaagaatgagacgagctgagccagcagcagatggggtgggagcagtatctcgagacctagaaaaacatggagcaatcacaagtagcaatacagcagctaacaatgctgcttgtgcctggctagaagcacaagaggaggaagaggtgggttttccagtcacacctcaggtacctttaagaccaatgacttacaaggcagctgtagatcttagccactttttaaaagaaaaggggggactggaagggctaattcactcccaaagaagacaagatatccttgatctgtggatctaccacacacaaggctacttccctgattggcagaactacacaccagggccaggggtcagatatccactgacctttggatggtgctacaagctagtaccagttgagccagataaggtagaagaggccaataaaggagagaacaccagcttgttacaccctgtgagcctgcatggaatggatgaccctgagagagaagtgttagagtggaggtttgacagccgcctagcatttcatcacgtggcccgagagctgcatccggagtacttcaagaactgctgacatcgagcttgctacaagggactttccgctggggactttccagggaggcgtggcctgggcgggactggggagtggcgagccctcagatgctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagca

SEQ ID NO: 92 - DNA, 6378 bp, Artificial Sequence
  Synthetic Sequence
tggaagggctaatttggtcccaaaaaagacaagagatccttgatctgtggatctaccacacacaaggctacttccctgattggcagaactacacaccagggccagggatcagatatccactgacctttggatggtgcttcaagttagtaccagttgaaccagagcaagtagaagaggccaatgaaggagagaacaacagcttgttacaccctatgagccagcatgggatggaggacccggagggagaagtattagtgtggaagtttgacagcctcctagcatttcgtcacatggcccgagagctgcatccggagtactacaaagactgctgacatcgagctttctacaagggactttccgctggggactttccagggaggtgtggcctgggcgggactggggagtggcgagccctcagatgctacatataagcagctgctttttgcctgtactgggtctctctggttagaccagatctgagcctgggagctctctggctaactagggaacccactgcttaagcctcaataaagcttgccttgagtgctcaaagtagtgtgtgcccgtctgttgtgtgactctggtaactagagatccctcagacccttttagtcagtgtggaaaatctctagcagtggcgcccgaacagggacttgaaagcgaaagtaaagccagaggagatctctcgacgcaggactcggcttgctgaagcgcgcacggcaagaggcgaggggcggcgactggtgagtacgccaaaaattttgactagcggaggctagaaggagagagatgggtgcgagagcgtcggtattaagcgggggagaattagataaatgggaaaaaattcggttaaggccagggggaaagaaacaatataaactaaaacatatagtatgggcaagcagggagctagaacgattcgcagttaatcctggccttttagagacatcagaaggctgtagacaaatactgggacagctacaaccatcccttcagacaggatcagaagaacttagatcattatataatacaatagcagtcctctattgtgtgcatcaaaggatagatgtaaaagacaccaaggaagccttagataagatagaggaagagcaaaacaaaagtaagaaaaaggcacagcaagcagcagctgacacaggaaacaacagccaggtcagccaaaattaccctatagtgcagaacctccaggggcaaatggtacatcaggccatatcacctagaactttaaatgcatgggtaaaagtagtagaagagaaggctttcagcccagaagtaatacccatgttttcagcattatcagaaggagccaccccacaagatttaaataccatgctaaacacagtggggggacatcaagcagccatgcaaatgttaaaagagaccatcaatgaggaagctgcagaatgggatagattgcatccagtgcatgcaccgtccatgaagggttcgatcaggcagctcaagaaacacgtatggcaacggcagattcgttttccacagggatggaaaggatcaccagcaatattccagtgtagcatgacaaaaatcttagagccttttagaaaacaaaatccagacatagtcatctatcaatacatggatgatttgtatgtaggatctgacttagaaatagggcagcatagaacaaaaatagaggaactgagacaacatctgttgaggtggggatttaccacaccagacaaaaaacatcagaaagaacctccattcctttggatgggttatgaactccatcctgataaatggacagtacagcctatagtgctgccagaaaaggacagctggactgtcaatgacatacagaaattagtgggaaaattgaattgggcaagtcagatttatgcagggattaaagtaaggcaattatgtaaacttcttaggggaaccaaagcactaacagaagtagtaccactaacagaagaagcagagctagaactggcagaaaacagggagattctaaaagaaccggtacatggagtgtattatgacccatcaaaagacttaatagcagaaatacagaagcaggggcaaggccaatggacatatcaaatttatcaagagccatttaaaaatctgaaaacaggaaagtatgcaagaatgaacgaatctgccgttgccatatacagcatctgaacaagctgatcgaacccttcatggacggttaaggccgcctgttggtgggcggggatcaagcaggaatttggcattccctacaatccccaaagtcaaggagtaatagaatctatgaataaagaattaaagaaaattataggacaggtaagagatcaggctgaacatcttaagacagcagtacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggaaaggaccagcaaagctcctctggaaaggtgaaggggcagtagtaatacaagataatagtgacataaaagtagtgccaagaagaaaagcaaagatcatcagggattatggaaaacagatggcaggtgatgattgtgtggcccgtccatgaagggttcgattcttgaacagcgcggtctgttatggcaacggcagattcgtttaatgcaacctataatagtagcaatagtagcattagtagtagcaataataatagcaatagttgtgtggtccatagtaatcatagaatataggaaaatattaagacaaagaaaaatagacaggttaattgatagactaatagaaagagcagaagacagtggcaatgagagtgaaggagaagtatcagcacttgtggagatgggggtggaaatggggcaccatgctccttgggatattgatgatctgtagtgctacagaaaaattgtgggtcacagtctattatggggtacctgtgtggaaggaagcaaccaccactctattttgtgcatcagatgctaaagcatatgatacagaggtacataatgtttgggccacacatgcctgtgtacccacagaccccaacccacaagaagtagtattggtaaatgtgacagaaaattttaacatgtggaaaaatgacatggtagaacagatgcatgaggatataatcagtttatgggatcaaagcctaaagccatgtgtaaaattaaccccactctgtgttagtttaaagtgcactgatttgaagaatgatactaataccaatagtagtagcgggagaatgataatggagaaaggagagataaaaaactgctctttcaatatcagcacaagcataagagataaggtgcagaaagaatatgcattcttttataaacttgatatagtaccaatagataataccagctataggttgataagttgtaacacctcagtcattacacaggcctgtccaaaggtatcctttgagccaattcccatacattattgtgccccggctggttttgcgattctaaaatgtaataataagacgttcaatggaacaggaccatgtacaaatgtcagcacagtacaatgtacacatggaatcaggccagtagtatcaactcaactgctgttaaatggcagtctagcagaagaagatgtagtaattagatctgccaatttcacagacaatgctaaaaccataatagtacagctgaacacatctgtagaaattaattgtacaagacccaacaacaatacaagaaaaagtatccgtatccagaggggaccagggagagcatttgttacaataggaaaaataggaaatatgagacaagcacattgtaacattagtagagcaaaatggaatgccactttaaaacagatagctagcaaattaagagaacaatttggaaataataaaacaataatctttaagcaatcctcaggaggggacccagaaattgtaacgcacagttttaattgtggaggggaatttttctactgtaattcaacacaactgtttaatagtacttggtttaatagtacttggagtactgaagggtcaaataacactgaaggaagtgacacaatcacactcccatgcagaataaaacaatttataaacatgtggcaggaagtaggaaaagcaatgtatgcccctcccatcagtggacaaattagatgttcatcaaatattactgggctgctattaacaagagatggtggtaataacaacaatgggtccgagatcttcagacctggaggaggcgatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctgatatagtgcagcagcagaacaatttgctgagggctattgaggcgcaacagcatctgttgcaactcacagtctggggcatcaaacagctccaggcaagaatcctggctgtggaaagatacctaaaggatcaacagctcctggggatttggggttgctctggaaaactcatttgcaccactgctgtgccttggaatgctagttggagtaataaatctctggaacagatttggaataacatgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaatcccgaggggacccgacaggcccgaaggaatagaagaagaaggtggagagagagacagagacagatccattcgattagtgaacggatccttagcacttatctgggacgatctgcggagcctgtgcctcttcagctaccaccgcttgagagacttactcttgattgtaacgaggattgtggaacttctgggacgcagggggtgggaagccctcaaatattggtggaatctcctacagtattggagtcaggaactaaagaatagtgctgttaacttgctcaatgccacagccatagcagtagctgaggggacagatagggttatagaagtattacaagcagcttatagagctattcgccacatacctagaagaataagacagggcttggaaaggattttgctataagatgggtggcaagtggtcaaaaagtagtgtgattggatggcctgctgtaagggaaagaatgagacgagctgagccagcagcagatggggtgggagcagtatctcgagacctagaaaaacatggagcaatcacaagtagcaatacagcagctaacaatgctgcttgtgcctggctagaagcacaagaggaggaagaggtgggttttccagtcacacctcaggtacctttaagaccaatgacttacaaggcagctgtagatcttagccactttttaaaagaaaaggggggactggaagggctaattcactcccaaagaagacaagatatccttgatctgtggatctaccacacacaaggctacttccctgattggcagaactacacaccagggccaggggtcagatatccactgacctttggatggtgctacaagctagtaccagttgagccagataaggtagaagaggccaataaaggagagaacaccagcttgttacaccctgtgagcctgcatggaatggatgaccctgagagagaagtgttagagtggaggtttgacagccgcctagcatttcatcacgtggcccgagagctgcatccggagtacttcaagaactgctgacatcgagcttgctacaagggactttccgctggggactttccagggaggcgtggcctgggcgggactggggagtggcgagccctcagatgctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagca

SEQ ID NO: 93 - DNA, 6153 bp, Artificial Sequence
  Synthetic Sequence
tggaagggctaatttggtcccaaaaaagacaagagatccttgatctgtggatctaccacacacaaggctacttccctgattggcagaactacacaccagggccagggatcagatatccactgacctttggatggtgcttcaagttagtaccagttgaaccagagcaagtagaagaggccaatgaaggagagaacaacagcttgttacaccctatgagccagcatgggatggaggacccggagggagaagtattagtgtggaagtttgacagcctcctagcatttcgtcacatggcccgagagctgcatccggagtactacaaagactgctgacatcgagctttctacaagggactttccgctggggactttccagggaggtgtggcctgggcgggactggggagtggcgagccctcagatgctacatataagcagctgctttttgcctgtactgggtctctctggttagaccagatctgagcctgggagctctctggctaactagggaacccactgcttaagcctcaataaagcttgccttgagtgctcaaagtagtgtgtgcccgtctgttgtgtgactctggtaactagagatccctcagacccttttagtcagtgtggaaaatctctagcagtggcgcccgaacagggacttgaaagcgaaagtaaagccagaggagatctctcgacgcaggactcggcttgctgaagcgcgcacggcaagaggcgaggggcggcgactggtgagtacgccaaaaattttgactagcggaggctagaaggagagagatgggtgcgagagcgtcggtattaagcgggggagaattagataaatgggaaaaaattcggttaaggccagggggaaagaaacaatataaactaaaacatatagtatgggcaagcagggagctagaacgattcgcagttaatcctggccttttagagacatcagaaggctgtagacaaatactgggacagctacaaccatcccttcagacaggatcagaagaacttagatcattatataatacaatagcagtcctctattgtgtgcatcaaaggatagatgtaaaagacaccaaggaagccttagataagatagaggaagagcaaaacaaaagtaagaaaaaggcacagcaagcagcagctgacacaggaaacaacagccaggtcagccaaaattaccctatagtgcagaacctccaggggcaaatggtacatcaggccatatcacctagaactttaaatgcatgggtaaaagtagtagaagagaaggctttcagcccagaagtaatacccatgttttcagcattatcagaaggagccaccccacaagatttaaataccatgctaaacacagtggggggacatcaagcagccatgcaaatgttaaaagagaccatcaatgaggaagctgcagaatgggatagattgcatccagtgcatgcaccgtccatgaagggttcgatcaggcagctcaagaaacacgtatggcaacggcagattcgttttccacagggatggaaaggatcaccagcaatattccagtgtagcatgacaaaaatcttagagccttttagaaaacaaaatccagacatagtcatctatcaatacatggatgatttgtatgtaggatctgacttagaaatagggcagcatagaacaaaaatagaggaactgagacaacatctgttgaggtggggatttaccacaccagacaaaaaacatcagaaagaacctccattcctttggatgggttatgaactccatcctgataaatggacagtacagcctatagtgctgccagaaaaggacagctggactgtcaatgacatacagaaattagtgggaaaattgaattgggcaagtcagatttatgcagggattaaagtaaggcaattatgtaaacttcttaggggaaccaaagcactaacagaagtagtaccactaacagaagaagcagagctagaactggcagaaaacagggagattctaaaagaaccggtacatggagtgtattatgacccatcaaaagacttaatagcagaaatacagaagcaggggcaaggccaatggacatatcaaatttatcaagagccatttaaaaatctgaaaacaggaaagtatgcaagaatgaacgaatctgccgttgccatatacagcatctgaacaagctgatcgaacccttcatggacggttaaggccgcctgttggtgggcggggatcaagcaggaatttggcattccctacaatccccaaagtcaaggagtaatagaatctatgaataaagaattaaagaaaattataggacaggtaagagatcaggctgaacatcttaagacagcagtacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggaaaggaccagcaaagctcctctggaaaggtgaaggggcagtagtaatacaagataatagtgacataaaagtagtgccaagaagaaaagcaaagatcatcagggattaaccgtccatgaagggttcgattatctgtagccaacattcgatatggcaacggcagattcgttggagatgggggtggaaatggggcaccatgctccttgggatattgatgatctgtagtgctacagaaaaattgtgggtcacagtctattatggggtacctgtgtggaaggaagcaaccaccactctattttgtgcatcagatgctaaagcatatgatacagaggtacataatgtttgggccacacatgcctgtgtacccacagaccccaacccacaagaagtagtattggtaaatgtgacagaaaattttaacatgtggaaaaatgacatggtagaacagatgcatgaggatataatcagtttatgggatcaaagcctaaagccatgtgtaaaattaaccccactctgtgttagtttaaagtgcactgatttgaagaatgatactaataccaatagtagtagcgggagaatgataatggagaaaggagagataaaaaactgctctttcaatatcagcacaagcataagagataaggtgcagaaagaatatgcattcttttataaacttgatatagtaccaatagataataccagctataggttgataagttgtaacacctcagtcattacacaggcctgtccaaaggtatcctttgagccaattcccatacattattgtgccccggctggttttgcgattctaaaatgtaataataagacgttcaatggaacaggaccatgtacaaatgtcagcacagtacaatgtacacatggaatcaggccagtagtatcaactcaactgctgttaaatggcagtctagcagaagaagatgtagtaattagatctgccaatttcacagacaatgctaaaaccataatagtacagctgaacacatctgtagaaattaattgtacaagacccaacaacaatacaagaaaaagtatccgtatccagaggggaccagggagagcatttgttacaataggaaaaataggaaatatgagacaagcacattgtaacattagtagagcaaaatggaatgccactttaaaacagatagctagcaaattaagagaacaatttggaaataataaaacaataatctttaagcaatcctcaggaggggacccagaaattgtaacgcacagttttaattgtggaggggaatttttctactgtaattcaacacaactgtttaatagtacttggtttaatagtacttggagtactgaagggtcaaataacactgaaggaagtgacacaatcacactcccatgcagaataaaacaatttataaacatgtggcaggaagtaggaaaagcaatgtatgcccctcccatcagtggacaaattagatgttcatcaaatattactgggctgctattaacaagagatggtggtaataacaacaatgggtccgagatcttcagacctggaggaggcgatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctgatatagtgcagcagcagaacaatttgctgagggctattgaggcgcaacagcatctgttgcaactcacagtctggggcatcaaacagctccaggcaagaatcctggctgtggaaagatacctaaaggatcaacagctcctggggatttggggttgctctggaaaactcatttgcaccactgctgtgccttggaatgctagttggagtaataaatctctggaacagatttggaataacatgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaatcccgaggggacccgacaggcccgaaggaatagaagaagaaggtggagagagagacagagacagatccattcgattagtgaacggatccttagcacttatctgggacgatctgcggagcctgtgcctcttcagctaccaccgcttgagagacttactcttgattgtaacgaggattgtggaacttctgggacgcagggggtgggaagccctcaaatattggtggaatctcctacagtattggagtcaggaactaaagaatagtgctgttaacttgctcaatgccacagccatagcagtagctgaggggacagatagggttatagaagtattacaagcagcttatagagctattcgccacatacctagaagaataagacagggcttggaaaggattttgctataagatgggtggcaagtggtcaaaaagtagtgtgattggatggcctgctgtaagggaaagaatgagacgagctgagccagcagcagatggggtgggagcagtatctcgagacctagaaaaacatggagcaatcacaagtagcaatacagcagctaacaatgctgcttgtgcctggctagaagcacaagaggaggaagaggtgggttttccagtcacacctcaggtacctttaagaccaatgacttacaaggcagctgtagatcttagccactttttaaaagaaaaggggggactggaagggctaattcactcccaaagaagacaagatatccttgatctgtggatctaccacacacaaggctacttccctgattggcagaactacacaccagggccaggggtcagatatccactgacctttggatggtgctacaagctagtaccagttgagccagataaggtagaagaggccaataaaggagagaacaccagcttgttacaccctgtgagcctgcatggaatggatgaccctgagagagaagtgttagagtggaggtttgacagccgcctagcatttcatcacgtggcccgagagctgcatccggagtacttcaagaactgctgacatcgagcttgctacaagggactttccgctggggactttccagggaggcgtggcctgggcgggactggggagtggcgagccctcagatgctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagca

SEQ ID NO: 94 - DNA, 8864 bp, Artificial Sequence
  Synthetic Sequence
tggaagggctaatttggtcccaaaaaagacaagagatccttgatctgtggatctaccacacacaaggctacttccctgattggcagaactacacaccagggccagggatcagatatccactgacctttggatggtgcttcaagttagtaccagttgaaccagagcaagtagaagaggccaatgaaggagagaacaacagcttgttacaccctatgagccagcatgggatggaggacccggagggagaagtattagtgtggaagtttgacagcctcctagcatttcgtcacatggcccgagagctgcatccggagtactacaaagactgctgacatcgagctttctacaagggactttccgctggggactttccagggaggtgtggcctgggcgggactggggagtggcgagccctcagatgctacatataagcagctgctttttgcctgtactgggtctctctggttagaccagatctgagcctgggagctctctggctaactagggaacccactgcttaagcctcaataaagcttgccttgagtgctcaaagtagtgtgtgcccgtctgttgtgtgactctggtaactagagatccctcagacccttttagtcagtgtggaaaatctctagcagtggcgcccgaacagggacttgaaagcgaaagtaaagccagaggagatctctcgacgcaggactcggcttgctgaagcgcgcacggcaagaggcgaggggcggcgactggtgagtacgccaaaaattttgactagcggaggctagaaggagagagatgggtgcgagagcgtcggtattaagcgggggagaattagataaatgggaaaaaattcggttaaggccagggggaaagaaacaatataaactaaaacatatagtatgggcaagcagggagctagaacgattcgcagttaatcctggccttttagagacatcagaaggctgtagacaaatactgggacagctacaaccatcccttcagacaggatcagaagaacttagatcattatataatacaatagcagtcctctattgtgtgcatcaaaggatagatgtaaaagacaccaaggaagccttagataagatagaggaagagcaaaacaaaagtaagaaaaaggcacagcaagcagcagctgacacaggaaacaacagccaggtcagccaaaattaccctatagtgcagaacctccaggggcaaatggtacatcaggccatatcacctagaactttaaatgcatgggtaaaagtagtagaagagaaggctttcagcccagaagtaatacccatgttttcagcattatcagaaggagccaccccacaagatttaaataccatgctaaacacagtggggggacatcaagcagccatgcaaatgttaaaagagaccatcaatgaggaagctgcagaatgggatagattgcatccagtgcatgcagggcctattgcaccaggccaaacgaatctgccgttgccatatgcagacattacactgtcgaatcgaacccttcatggacggtggaaaccaaaaatgatagggggaattggaggttttatcaaagtaagacagtatgatcagatactcatagaaatctgcggacataaagctataggtacagtattagtaggacctacacctgtcaacataattggaagaaatctgttgactcagattggctgcactttaaattttcccattagtcctattgagactgtaccagtaaaattaaagccaggaatggatggcccaaaagttaaacaatggccattgacagaagaaaaaataaaagcattagtagaaatttgtacagaaatggaaaaggaaggaaaaatttcaaaaattgggcctgaaaatccatacaatactccagtatttgccataaagaaaaaagacagtactaaatggagaaaattagtagatttcagagaacttaataagagaactcaagatttctgggaagttcaattaggaataccacatcctgcagggttaaaacagaaaaaatcagtaacagtactggatgtgggcgatgcatatttttcagttcccttagataaagacttcaggaagtatactgcatttaccatacctagtataaacaatgagacaccagggattagatatcagtacaatgtgcttccacagggatggaaaggatcaccagcaatattccagtgtagcatgacaaaaatcttagagccttttagaaaacaaaatccagacatagtcatctatcaatacatggatgatttgtatgtaggatctgacttagaaatagggcagcatagaacaaaaatagaggaactgagacaacatctgttgaggtggggatttaccacaccagacaaaaaacatcagaaagaacctccattcctttggatgggttatgaactccatcctgataaatggacagtacagcctatagtgctgccagaaaaggacagctggactgtcaatgacatacagaaattagtgggaaaattgaattgggcaagtcagatttatgcagggattaaagtaaggcaattatgtaaacttcttaggggaaccaaagcactaacagaagtagtaccactaacagaagaagcagagctagaactggcagaaaacagggagattctaaaagaaccggtacatggagtgtattatgacccatcaaaagacttaatagcagaaatacagaagcaggggcaaggccaatggacatatcaaatttatcaagagccatttaaaaatctgaaaacaggaaagtatgcaagaatgaagggtgcccacactaatgatgtgaaacaattaacagaggcagtacaaaaaatagccacagaaagcatagtaatatggggaaagactcctaaatttaaattacccatacaaaaggaaacatgggaagcatggtggacagagtattggcaagccacctggattcctgagtgggagtttgtcaatacccctcccttagtgaagttatggtaccagttagagaaagaacccataataggagcagaaactttctatgtagatggggcagccaatagggaaactaaattaggaaaagcaggatatgtaactgacagaggaagacaaaaagttgtccccctaacggacacaacaaatcagaagactgagttacaagcaattcatctagctttgcaggattcgggattagaagtaaacatagtgacagactcacaatatgcattgggaatcattcaagcacaaccagataagagtgaatcagagttagtcagtcaaataatagagcagttaataaaaaaggaaaaagtctacctggcatgggtaccagcacacaaaggaattggaggaaatgaacaagtagataaattggtcagtgctggaatcaggaaagtactatttttagatggaatagataaggcccaagaagaacatgagaaatatcacagtaattggagagcaatggctagtgattttaacctaccacctgtagtagcaaaagaaatagtagccagctgtgataaatgtcagctaaaaggggaagccatgcatggacaagtagactgtagcccaggaatatggcagctagattgtacacatttagaaggaaaagttatcttggtagcagttcatgtagccagtggatatatagaagcagaagtaattccagcagagacagggcaagaaacagcatacttcctcttaaaattagcaggaagatggccagtaaaaacagtacatacagacaatggcagcaatttcaccagtactacagttaaggccgcctgttggtgggcggggatcaagcaggaatttggcattccctacaatccccaaagtcaaggagtaatagaatctatgaataaagaattaaagaaaattataggacaggtaagagatcaggctgaacatcttaagacagcagtacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggaaaggaccagcaaagctcctctggaaaggtgaaggggcagtagtaatacaagataatagtgacataaaagtagtgccaagaagaaaagcaaagatcatcagggattatggaaaacagatggcaggtgatgattgtgtggcaagtagacaggatgaggattaacacatggaaaagattagtaaaacaccatatgtatatttcaaggaaagctaaggactggttttatagacatcactatgaaagtactaatccaaaaataagttcagaagtacacatcccactaggggatgctaaattagtaataacaacatattggggtctgcatacaggagaaagagactggcatttgggtcagggagtctccatagaatggaggaaaaagagatatagcacacaagtagaccctgacctagcagaccaactaattcatctgcactattttgattgtttttcagaatctgctataagaaataccatattaggacgtatagttagtcctaggtgtgaatatcaagcaggacataacaaggtaggatctctacagtacttggcactagcagcattaataaaaccaaaacagataaagccacctttgcctagtgttaggaaactgacagaggacagatggaacaagccccagaagaccaagggccacagagggagccatacaatgaatggacactagagcttttagaggaacttaagagtgaagctgttagacattttcctaggatatggctccataacttaggacaacatatctatgaaacttacggggatacttgggcaggagtggaagccataataagaattctgcaacaactgctgtttatccatttcagaattgggtgtcgacatagcagaataggcgttactcgacagaggagagcaagaaatggagccagtagatcctagactagagccctggaagcatccaggaagtcagcctaaaactgcttgtaccaattgctattgtaaaaagtgttgctttcattgccaagtttgtttcatgacaaaagccttaggcatctcctatggcaggaagaagcggagacagcgacgaagagctcatcagaacagtcagactcatcaagcttctctatcaaagcagtaagtagtacatgtaatgcaacctataatagtagcaatagtagcattagtagtagcaataataatagcaatagttgtgtggtccatagtaatcatagaatataggaaaatattaagacaaagaaaaatagacaggttaattgatagactaatagaaagagcagaagacagtggcaatgagagtgaaggagaagtatcagcacttgtggagatgggggtggaaatggggcaccatgctccttgggatattgatgatctgtagtgctacagaaaaattgtgggtcacagtctattatggggtacctgtgtggaaggaagcaaccaccactctattttgtgcatcagatgctaaagcatatgatacagaggtacataatgtttgggccacacatgcctgtgtacccacagaccccaacccacaagaagtagtattggtaaatgtgacagaaaattttaacatgtggaaaaatgacatggtagaacagatgcatgaggatataatcagtttatgggatcaaagcctaaagccatgtgtaaaattaaccccactctgtgttagtttaaagtgcactgatttgaagaatgatactaataccaatagtagtagcgggagaatgataatggagaaaggagagataaaaaactgctctttcaatatcagcacaagcataagagataaggtgcagaaagaatatgcattcttttataaacttgatatagtaccaatagataataccagctataggttgataagttgtaacacctcagtcattacacaggcctgtccaaaggtatcctttgagccaattcccatacattattgtgccccggctggttttgcgattctaaaatgtaataataagacgttcaatggaacaggaccatgtacaaatgtcagcacagtacaatgtacacatggaatcaggccagtagtatcaactcaactgctgttaaatggcagtctagcagaagaagatgtagtaattagatctgccaatttcacagacaatgctaaaaccataatagtacagctgaacacatctgtagaaattaattgtacaagacccaacaacaatacaagaaaaagtatccgtatccagaggggaccagggagagcatttgttacaataggaaaaataggaaatatgagacaagcacattgtaacattagtagagcaaaatggaatgccactttaaaacagatagctagcaaattaagagaacaatttggaaataataaaacaataatctttaagcaatcctcaggaggggacccagaaattgtaacgcacagttttaattgtggaggggaatttttctactgtaattcaacacaactgtttaatagtacttggtttaatagtacttggagtactgaagggtcaaataacactgaaggaagtgacacaatcacactcccatgcagaataaaacaatttataaacatgtggcaggaagtaggaaaagcaatgtatgcccctcccatcagtggacaaattagatgttcatcaaatattactgggctgctattaacaagagatggtggtaataacaacaatgggtccgagatcttcagacctggaggaggcgatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctgatatagtgcagcagcagaacaatttgctgagggctattgaggcgcaacagcatctgttgcaactcacagtctggggcatcaaacagctccaggcaagaatcctggctgtggaaagatacctaaaggatcaacagctcctggggatttggggttgctctggaaaactcatttgcaccactgctgtgccttggaatgctagttggagtaataaatctctggaacagatttggaataacatgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaatcccgaggggacccgacaggcccgaaggaatagaagaagaaggtggagagagagacagagacagatccattcgattagtgaacggatccttagcacttatctgggacgatctgcggagcctgtgcctcttcagctaccaccgcttgagagacttactcttgattgtaacgaggattgtggaacttctgggacgcagggggtgggaagccctcaaatattggtggaatctcctacagtattggagtcaggaactaaagaatagtgctgttaacttgctcaatgccacagccatagcagtagctgaggggacagatagggttatagaagtattacaagcagcttatagagctattcgccacatacctagaagaataagacagggcttggaaaggattttgctataagatgggtggcaagtggtcaaaaagtagtgtgattggatggcctgctgtaagggaaagaatgagacgagctgagccagcagcagatggggtgggagcagtatctcgagacctagaaaaacatggagcaatcacaagtagcaatacagcagctaacaatgctgcttgtgcctggctagaagcacaagaggaggaagaggtgggttttccagtcacacctcaggtacctttaagaccaatgacttacaaggcagctgtagatcttagccactttttaaaagaaaaggggggactggaagggctaattcactcccaaagaagacaagatatccttgatctgtggatctaccacacacaaggctacttccctgattggcagaactacacaccagggccaggggtcagatatccactgacctttggatggtgctacaagctagtaccagttgagccagataaggtagaagaggccaataaaggagagaacaccagcttgttacaccctgtgagcctgcatggaatggatgaccctgagagagaagtgttagagtggaggtttgacagccgcctagcatttcatcacgtggcccgagagctgcatccggagtacttcaagaactgctgacatcgagcttgctacaagggactttccgctggggactttccagggaggcgtggcctgggcgggactggggagtggcgagccctcagatgctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagca

SEQ ID NO: 95 - DNA, 7941 bp, Artificial Sequence
  Synthetic Sequence
tggaagggctaatttggtcccaaaaaagacaagagatccttgatctgtggatctaccacacacaaggctacttccctgattggcagaactacacaccagggccagggatcagatatccactgacctttggatggtgcttcaagttagtaccagttgaaccagagcaagtagaagaggccaatgaaggagagaacaacagcttgttacaccctatgagccagcatgggatggaggacccggagggagaagtattagtgtggaagtttgacagcctcctagcatttcgtcacatggcccgagagctgcatccggagtactacaaagactgctgacatcgagctttctacaagggactttccgctggggactttccagggaggtgtggcctgggcgggactggggagtggcgagccctcagatgctacatataagcagctgctttttgcctgtactgggtctctctggttagaccagatctgagcctgggagctctctggctaactagggaacccactgcttaagcctcaataaagcttgccttgagtgctcaaagtagtgtgtgcccgtctgttgtgtgactctggtaactagagatccctcagacccttttagtcagtgtggaaaatctctagcagtggcgcccgaacagggacttgaaagcgaaagtaaagccagaggagatctctcgacgcaggactcggcttgctgaagcgcgcacggcaagaggcgaggggcggcgactggtgagtacgccaaaaattttgactagcggaggctagaaggagagagatgggtgcgagagcgtcggtattaagcgggggagaattagataaatgggaaaaaattcggttaaggccagggggaaagaaacaatataaactaaaacatatagtatgggcaagcagggagctagaacgattcgcagttaatcctggccttttagagacatcagaaggctgtagacaaatactgggacagctacaaccatcccttcagacaggatcagaagaacttagatcattatataatacaatagcagtcctctattgtgtgcatcaaaggatagatgtaaaagacaccaaggaagccttagataagatagaggaagagcaaaacaaaagtaagaaaaaggcacagcaagcagcagctgacacaggaaacaacagccaggtcagccaaaattaccctatagtgcagaacctccaggggcaaatggtacatcaggccatatcacctagaactttaaatgcatgggtaaaagtagtagaagagaaggctttcagcccagaagtaatacccatgttttcagcattatcagaaggagccaccccacaagatttaaataccatgctaaacacagtggggggacatcaagcagccatgcaaatgttaaaagagaccatcaatgaggaagctgcagaatgggatagattgcatccagtgcatgcagggcctattgcaccaggccaaacgaatctgccgttgccatatgcagacattacactgtcgaatcgaacccttcatggacggtggaaaccaaaaatgatagggggaattggaggttttatcaaagtaagacagtatgatcagatactcatagaaatctgcggacataaagctataggtacagtattagtaggacctacacctgtcaacataattggaagaaatctgttgactcagattggctgcactttaaattttcccattagtcctattgagactgtaccagtaaaattaaagccaggaatggatggcccaaaagttaaacaatggccattgacagaagaaaaaataaaagcattagtagaaatttgtacagaaatggaaaaggaaggaaaaatttcaaaaattgggcctgaaaatccatacaatactccagtatttgccataaagaaaaaagacagtactaaatggagaaaattagtagatttcagagaacttaataagagaactcaagatttctgggaagttcaattaggaataccacatcctgcagggttaaaacagaaaaaatcagtaacagtactggatgtgggcgatgcatatttttcagttcccttagataaagacttcaggaagtatactgcatttaccatacctagtataaacaatgagacaccagggattagatatcagtacaatgtgcttccacagggatggaaaggatcaccagcaatattccagtgtagcatgacaaaaatcttagagccttttagaaaacaaaatccagacatagtcatctatcaatacatggatgatttgtatgtaggatctgacttagaaatagggcagcatagaacaaaaatagaggaactgagacaacatctgttgaggtggggatttaccacaccagacaaaaaacatcagaaagaacctccattcctttggatgggttatgaactccatcctgataaatggacagtacagcctatagtgctgccagaaaaggacagctggactgtcaatgacatacagaaattagtgggaaaattgaattgggcaagtcagatttatgcagggattaaagtaaggcaattatgtaaacttcttaggggaaccaaagcactaacagaagtagtaccactaacagaagaagcagagctagaactggcagaaaacagggagattctaaaagaaccggtacatggagtgtattatgacccatcaaaagacttaatagcagaaatacagaagcaggggcaaggccaatggacatatcaaatttatcaagagccatttaaaaatctgaaaacaggaaagtatgcaagaatgaagggtgcccacactaatgatgtgaaacaattaacagaggcagtacaaaaaatagccacagaaagcatagtaatatggggaaagactcctaaatttaaattacccatacaaaaggaaacatgggaagcatggtggacagagtattggcaagccacctggattcctgagtgggagtttgtcaatacccctcccttagtgaagttatggtaccagttagagaaagaacccataataggagcagaaactttctatgtagatggggcagccaatagggaaactaaattaggaaaagcaggatatgtaactgacagaggaagacaaaaagttgtccccctaacggacacaacaaatcagaagactgagttacaagcaattcatctagctttgcaggattcgggattagaagtaaacatagtgacagactcacaatatgcattgggaatcattcaagcacaaccagataagagtgaatcagagttagtcagtcaaataatagagcagttaataaaaaaggaaaaagtctacctggcatgggtaccagcacacaaaggaattggaggaaatgaacaagtagataaattggtcagtgctggaatcaggaaagtactatttttagatggaatagataaggcccaagaagaacatgagaaatatcacagtaattggagagcaatggctagtgattttaacctaccacctgtagtagcaaaagaaatagtagccagctgtgataaatgtcagctaaaaggggaagccatgcatggacaagtagactgtagcccaggaatatggcagctagattgtacacatttagaaggaaaagttatcttggtagcagttcatgtagccagtggatatatagaagcagaagtaattccagcagagacagggcaagaaacagcatacttcctcttaaaattagcaggaagatggccagtaaaaacagtacatacagacaatggcagcaatttcaccagtactacagttaaggccgcctgttggtgggcggggatcaagcaggaatttggcattccctacaatccccaaagtcaaggagtaatagaatctatgaataaagaattaaagaaaattataggacaggtaagagatcaggctgaacatcttaagacagcagtacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggaaaggaccagcaaagctcctctggaaaggtgaaggggcagtagtaatacaagataatagtgacataaaagtagtgccaagaagaaaagcaaagatcatcagggattatggaaaacagatggcaggtgatgattgtgtggcccgtccatgaagggttcgattcttgaacagcgcggtctgttatggcaacggcagattcgtttaatgcaacctataatagtagcaatagtagcattagtagtagcaataataatagcaatagttgtgtggtccatagtaatcatagaatataggaaaatattaagacaaagaaaaatagacaggttaattgatagactaatagaaagagcagaagacagtggcaatgagagtgaaggagaagtatcagcacttgtggagatgggggtggaaatggggcaccatgctccttgggatattgatgatctgtagtgctacagaaaaattgtgggtcacagtctattatggggtacctgtgtggaaggaagcaaccaccactctattttgtgcatcagatgctaaagcatatgatacagaggtacataatgtttgggccacacatgcctgtgtacccacagaccccaacccacaagaagtagtattggtaaatgtgacagaaaattttaacatgtggaaaaatgacatggtagaacagatgcatgaggatataatcagtttatgggatcaaagcctaaagccatgtgtaaaattaaccccactctgtgttagtttaaagtgcactgatttgaagaatgatactaataccaatagtagtagcgggagaatgataatggagaaaggagagataaaaaactgctctttcaatatcagcacaagcataagagataaggtgcagaaagaatatgcattcttttataaacttgatatagtaccaatagataataccagctataggttgataagttgtaacacctcagtcattacacaggcctgtccaaaggtatcctttgagccaattcccatacattattgtgccccggctggttttgcgattctaaaatgtaataataagacgttcaatggaacaggaccatgtacaaatgtcagcacagtacaatgtacacatggaatcaggccagtagtatcaactcaactgctgttaaatggcagtctagcagaagaagatgtagtaattagatctgccaatttcacagacaatgctaaaaccataatagtacagctgaacacatctgtagaaattaattgtacaagacccaacaacaatacaagaaaaagtatccgtatccagaggggaccagggagagcatttgttacaataggaaaaataggaaatatgagacaagcacattgtaacattagtagagcaaaatggaatgccactttaaaacagatagctagcaaattaagagaacaatttggaaataataaaacaataatctttaagcaatcctcaggaggggacccagaaattgtaacgcacagttttaattgtggaggggaatttttctactgtaattcaacacaactgtttaatagtacttggtttaatagtacttggagtactgaagggtcaaataacactgaaggaagtgacacaatcacactcccatgcagaataaaacaatttataaacatgtggcaggaagtaggaaaagcaatgtatgcccctcccatcagtggacaaattagatgttcatcaaatattactgggctgctattaacaagagatggtggtaataacaacaatgggtccgagatcttcagacctggaggaggcgatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctgatatagtgcagcagcagaacaatttgctgagggctattgaggcgcaacagcatctgttgcaactcacagtctggggcatcaaacagctccaggcaagaatcctggctgtggaaagatacctaaaggatcaacagctcctggggatttggggttgctctggaaaactcatttgcaccactgctgtgccttggaatgctagttggagtaataaatctctggaacagatttggaataacatgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaatcccgaggggacccgacaggcccgaaggaatagaagaagaaggtggagagagagacagagacagatccattcgattagtgaacggatccttagcacttatctgggacgatctgcggagcctgtgcctcttcagctaccaccgcttgagagacttactcttgattgtaacgaggattgtggaacttctgggacgcagggggtgggaagccctcaaatattggtggaatctcctacagtattggagtcaggaactaaagaatagtgctgttaacttgctcaatgccacagccatagcagtagctgaggggacagatagggttatagaagtattacaagcagcttatagagctattcgccacatacctagaagaataagacagggcttggaaaggattttgctataagatgggtggcaagtggtcaaaaagtagtgtgattggatggcctgctgtaagggaaagaatgagacgagctgagccagcagcagatggggtgggagcagtatctcgagacctagaaaaacatggagcaatcacaagtagcaatacagcagctaacaatgctgcttgtgcctggctagaagcacaagaggaggaagaggtgggttttccagtcacacctcaggtacctttaagaccaatgacttacaaggcagctgtagatcttagccactttttaaaagaaaaggggggactggaagggctaattcactcccaaagaagacaagatatccttgatctgtggatctaccacacacaaggctacttccctgattggcagaactacacaccagggccaggggtcagatatccactgacctttggatggtgctacaagctagtaccagttgagccagataaggtagaagaggccaataaaggagagaacaccagcttgttacaccctgtgagcctgcatggaatggatgaccctgagagagaagtgttagagtggaggtttgacagccgcctagcatttcatcacgtggcccgagagctgcatccggagtacttcaagaactgctgacatcgagcttgctacaagggactttccgctggggactttccagggaggcgtggcctgggcgggactggggagtggcgagccctcagatgctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagca

SEQ ID NO: 96 - DNA, 7716 bp, Artificial Sequence
  Synthetic Sequence
tggaagggctaatttggtcccaaaaaagacaagagatccttgatctgtggatctaccacacacaaggctacttccctgattggcagaactacacaccagggccagggatcagatatccactgacctttggatggtgcttcaagttagtaccagttgaaccagagcaagtagaagaggccaatgaaggagagaacaacagcttgttacaccctatgagccagcatgggatggaggacccggagggagaagtattagtgtggaagtttgacagcctcctagcatttcgtcacatggcccgagagctgcatccggagtactacaaagactgctgacatcgagctttctacaagggactttccgctggggactttccagggaggtgtggcctgggcgggactggggagtggcgagccctcagatgctacatataagcagctgctttttgcctgtactgggtctctctggttagaccagatctgagcctgggagctctctggctaactagggaacccactgcttaagcctcaataaagcttgccttgagtgctcaaagtagtgtgtgcccgtctgttgtgtgactctggtaactagagatccctcagacccttttagtcagtgtggaaaatctctagcagtggcgcccgaacagggacttgaaagcgaaagtaaagccagaggagatctctcgacgcaggactcggcttgctgaagcgcgcacggcaagaggcgaggggcggcgactggtgagtacgccaaaaattttgactagcggaggctagaaggagagagatgggtgcgagagcgtcggtattaagcgggggagaattagataaatgggaaaaaattcggttaaggccagggggaaagaaacaatataaactaaaacatatagtatgggcaagcagggagctagaacgattcgcagttaatcctggccttttagagacatcagaaggctgtagacaaatactgggacagctacaaccatcccttcagacaggatcagaagaacttagatcattatataatacaatagcagtcctctattgtgtgcatcaaaggatagatgtaaaagacaccaaggaagccttagataagatagaggaagagcaaaacaaaagtaagaaaaaggcacagcaagcagcagctgacacaggaaacaacagccaggtcagccaaaattaccctatagtgcagaacctccaggggcaaatggtacatcaggccatatcacctagaactttaaatgcatgggtaaaagtagtagaagagaaggctttcagcccagaagtaatacccatgttttcagcattatcagaaggagccaccccacaagatttaaataccatgctaaacacagtggggggacatcaagcagccatgcaaatgttaaaagagaccatcaatgaggaagctgcagaatgggatagattgcatccagtgcatgcagggcctattgcaccaggccaaacgaatctgccgttgccatatgcagacattacactgtcgaatcgaacccttcatggacggtggaaaccaaaaatgatagggggaattggaggttttatcaaagtaagacagtatgatcagatactcatagaaatctgcggacataaagctataggtacagtattagtaggacctacacctgtcaacataattggaagaaatctgttgactcagattggctgcactttaaattttcccattagtcctattgagactgtaccagtaaaattaaagccaggaatggatggcccaaaagttaaacaatggccattgacagaagaaaaaataaaagcattagtagaaatttgtacagaaatggaaaaggaaggaaaaatttcaaaaattgggcctgaaaatccatacaatactccagtatttgccataaagaaaaaagacagtactaaatggagaaaattagtagatttcagagaacttaataagagaactcaagatttctgggaagttcaattaggaataccacatcctgcagggttaaaacagaaaaaatcagtaacagtactggatgtgggcgatgcatatttttcagttcccttagataaagacttcaggaagtatactgcatttaccatacctagtataaacaatgagacaccagggattagatatcagtacaatgtgcttccacagggatggaaaggatcaccagcaatattccagtgtagcatgacaaaaatcttagagccttttagaaaacaaaatccagacatagtcatctatcaatacatggatgatttgtatgtaggatctgacttagaaatagggcagcatagaacaaaaatagaggaactgagacaacatctgttgaggtggggatttaccacaccagacaaaaaacatcagaaagaacctccattcctttggatgggttatgaactccatcctgataaatggacagtacagcctatagtgctgccagaaaaggacagctggactgtcaatgacatacagaaattagtgggaaaattgaattgggcaagtcagatttatgcagggattaaagtaaggcaattatgtaaacttcttaggggaaccaaagcactaacagaagtagtaccactaacagaagaagcagagctagaactggcagaaaacagggagattctaaaagaaccggtacatggagtgtattatgacccatcaaaagacttaatagcagaaatacagaagcaggggcaaggccaatggacatatcaaatttatcaagagccatttaaaaatctgaaaacaggaaagtatgcaagaatgaagggtgcccacactaatgatgtgaaacaattaacagaggcagtacaaaaaatagccacagaaagcatagtaatatggggaaagactcctaaatttaaattacccatacaaaaggaaacatgggaagcatggtggacagagtattggcaagccacctggattcctgagtgggagtttgtcaatacccctcccttagtgaagttatggtaccagttagagaaagaacccataataggagcagaaactttctatgtagatggggcagccaatagggaaactaaattaggaaaagcaggatatgtaactgacagaggaagacaaaaagttgtccccctaacggacacaacaaatcagaagactgagttacaagcaattcatctagctttgcaggattcgggattagaagtaaacatagtgacagactcacaatatgcattgggaatcattcaagcacaaccagataagagtgaatcagagttagtcagtcaaataatagagcagttaataaaaaaggaaaaagtctacctggcatgggtaccagcacacaaaggaattggaggaaatgaacaagtagataaattggtcagtgctggaatcaggaaagtactatttttagatggaatagataaggcccaagaagaacatgagaaatatcacagtaattggagagcaatggctagtgattttaacctaccacctgtagtagcaaaagaaatagtagccagctgtgataaatgtcagctaaaaggggaagccatgcatggacaagtagactgtagcccaggaatatggcagctagattgtacacatttagaaggaaaagttatcttggtagcagttcatgtagccagtggatatatagaagcagaagtaattccagcagagacagggcaagaaacagcatacttcctcttaaaattagcaggaagatggccagtaaaaacagtacatacagacaatggcagcaatttcaccagtactacagttaaggccgcctgttggtgggcggggatcaagcaggaatttggcattccctacaatccccaaagtcaaggagtaatagaatctatgaataaagaattaaagaaaattataggacaggtaagagatcaggctgaacatcttaagacagcagtacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggaaaggaccagcaaagctcctctggaaaggtgaaggggcagtagtaatacaagataatagtgacataaaagtagtgccaagaagaaaagcaaagatcatcagggattaaccgtccatgaagggttcgattatctgtagccaacattcgatatggcaacggcagattcgttggagatgggggtggaaatggggcaccatgctccttgggatattgatgatctgtagtgctacagaaaaattgtgggtcacagtctattatggggtacctgtgtggaaggaagcaaccaccactctattttgtgcatcagatgctaaagcatatgatacagaggtacataatgtttgggccacacatgcctgtgtacccacagaccccaacccacaagaagtagtattggtaaatgtgacagaaaattttaacatgtggaaaaatgacatggtagaacagatgcatgaggatataatcagtttatgggatcaaagcctaaagccatgtgtaaaattaaccccactctgtgttagtttaaagtgcactgatttgaagaatgatactaataccaatagtagtagcgggagaatgataatggagaaaggagagataaaaaactgctctttcaatatcagcacaagcataagagataaggtgcagaaagaatatgcattcttttataaacttgatatagtaccaatagataataccagctataggttgataagttgtaacacctcagtcattacacaggcctgtccaaaggtatcctttgagccaattcccatacattattgtgccccggctggttttgcgattctaaaatgtaataataagacgttcaatggaacaggaccatgtacaaatgtcagcacagtacaatgtacacatggaatcaggccagtagtatcaactcaactgctgttaaatggcagtctagcagaagaagatgtagtaattagatctgccaatttcacagacaatgctaaaaccataatagtacagctgaacacatctgtagaaattaattgtacaagacccaacaacaatacaagaaaaagtatccgtatccagaggggaccagggagagcatttgttacaataggaaaaataggaaatatgagacaagcacattgtaacattagtagagcaaaatggaatgccactttaaaacagatagctagcaaattaagagaacaatttggaaataataaaacaataatctttaagcaatcctcaggaggggacccagaaattgtaacgcacagttttaattgtggaggggaatttttctactgtaattcaacacaactgtttaatagtacttggtttaatagtacttggagtactgaagggtcaaataacactgaaggaagtgacacaatcacactcccatgcagaataaaacaatttataaacatgtggcaggaagtaggaaaagcaatgtatgcccctcccatcagtggacaaattagatgttcatcaaatattactgggctgctattaacaagagatggtggtaataacaacaatgggtccgagatcttcagacctggaggaggcgatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctgatatagtgcagcagcagaacaatttgctgagggctattgaggcgcaacagcatctgttgcaactcacagtctggggcatcaaacagctccaggcaagaatcctggctgtggaaagatacctaaaggatcaacagctcctggggatttggggttgctctggaaaactcatttgcaccactgctgtgccttggaatgctagttggagtaataaatctctggaacagatttggaataacatgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaatcccgaggggacccgacaggcccgaaggaatagaagaagaaggtggagagagagacagagacagatccattcgattagtgaacggatccttagcacttatctgggacgatctgcggagcctgtgcctcttcagctaccaccgcttgagagacttactcttgattgtaacgaggattgtggaacttctgggacgcagggggtgggaagccctcaaatattggtggaatctcctacagtattggagtcaggaactaaagaatagtgctgttaacttgctcaatgccacagccatagcagtagctgaggggacagatagggttatagaagtattacaagcagcttatagagctattcgccacatacctagaagaataagacagggcttggaaaggattttgctataagatgggtggcaagtggtcaaaaagtagtgtgattggatggcctgctgtaagggaaagaatgagacgagctgagccagcagcagatggggtgggagcagtatctcgagacctagaaaaacatggagcaatcacaagtagcaatacagcagctaacaatgctgcttgtgcctggctagaagcacaagaggaggaagaggtgggttttccagtcacacctcaggtacctttaagaccaatgacttacaaggcagctgtagatcttagccactttttaaaagaaaaggggggactggaagggctaattcactcccaaagaagacaagatatccttgatctgtggatctaccacacacaaggctacttccctgattggcagaactacacaccagggccaggggtcagatatccactgacctttggatggtgctacaagctagtaccagttgagccagataaggtagaagaggccaataaaggagagaacaccagcttgttacaccctgtgagcctgcatggaatggatgaccctgagagagaagtgttagagtggaggtttgacagccgcctagcatttcatcacgtggcccgagagctgcatccggagtacttcaagaactgctgacatcgagcttgctacaagggactttccgctggggactttccagggaggcgtggcctgggcgggactggggagtggcgagccctcagatgctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagca

SEQ ID NO: 97 - DNA, 7940 bp, Artificial Sequence
  Synthetic Sequence
tggaagggctaatttggtcccaaaaaagacaagagatccttgatctgtggatctaccacacacaaggctacttccctgattggcagaactacacaccagggccagggatcagatatccactgacctttggatggtgcttcaagttagtaccagttgaaccagagcaagtagaagaggccaatgaaggagagaacaacagcttgttacaccctatgagccagcatgggatggaggacccggagggagaagtattagtgtggaagtttgacagcctcctagcatttcgtcacatggcccgagagctgcatccggagtactacaaagactgctgacatcgagctttctacaagggactttccgctggggactttccagggaggtgtggcctgggcgggactggggagtggcgagccctcagatgctacatataagcagctgctttttgcctgtactgggtctctctggttagaccagatctgagcctgggagctctctggctaactagggaacccactgcttaagcctcaataaagcttgccttgagtgctcaaagtagtgtgtgcccgtctgttgtgtgactctggtaactagagatccctcagacccttttagtcagtgtggaaaatctctagcagtggcgcccgaacagggacttgaaagcgaaagtaaagccagaggagatctctcgacgcaggactcggcttgctgaagcgcgcacggcaagaggcgaggggcggcgactggtgagtacgccaaaaattttgactagcggaggctagaaggagagagatgggtgcgagagcgtcggtattaagcgggggagaattagataaatgggaaaaaattcggttaaggccagggggaaagaaacaatataaactaaaacatatagtatgggcaagcagggagctagaacgattcgcagttaatcctggccttttagagacatcagaaggctgtagacaaatactgggacagctacaaccatcccttcagacaggatcagaagaacttagatcattatataatacaatagcagtcctctattgtgtgcatcaaaggatagatgtaaaagacaccaaggaagccttagataagatagaggaagagcaaaacaaaagtaagaaaaaggcacagcaagcagcagctgacacaggaaacaacagccaggtcagccaaaattaccctatagtgcagaacctccaggggcaaatggtacatcaggccatatcacctagaactttaaatgcatgggtaaaagtagtagaagagaaggctttcagcccagaagtaatacccatgttttcagcattatcagaaggagccaccccacaagatttaaataccatgctaaacacagtggggggacatcaagcagccatgcaaatgttaaaagagaccatcaatgaggaagctgcagaatgggatagattgcatccagtgcatgcagggcctattgcaccaggccaaacgaatctgccgttgccatatgcagacattacactgtcgaatcgaacccttcatggacggtggaaaccaaaaatgatagggggaattggaggttttatcaaagtaagacagtatgatcagatactcatagaaatctgcggacataaagctataggtacagtattagtaggacctacacctgtcaacataattggaagaaatctgttgactcagattggctgcactttaaattttcccattagtcctattgagactgtaccagtaaaattaaagccaggaatggatggcccaaaagttaaacaatggccattgacagaagaaaaaataaaagcattagtagaaatttgtacagaaatggaaaaggaaggaaaaatttcaaaaattgggcctgaaaatccatacaatactccagtatttgccataaagaaaaaagacagtactaaatggagaaaattagtagatttcagagaacttaataagagaactcaagatttctgggaagttcaattaggaataccacatcctgcagggttaaaacagaaaaaatcagtaacagtactggatgtgggcgatgcatatttttcagttcccttagataaagacttcaggaagtatactgcatttaccatacctagtataaacaatgagacaccagggattagatatcagtacaatgtgcttccacagggatggaaaggatcaccagcaatattccagtgtagcatgacaaaaatcttagagccttttagaaaacaaaatccagacatagtcatctatcaatacatggatgatttgtatgtaggatctgacttagaaatagggcagcatagaacaaaaatagaggaactgagacaacatctgttgaggtggggatttaccacaccagacaaaaaacatcagaaagaacctccattcctttggatgggttatgaactccatcctgataaatggacagtacagcctatagtgctgccagaaaaggacagctggactgtcaatgacatacagaaattagtgggaaaattgaattgggcaagtcagatttatgcagggattaaagtaaggcaattatgtaaacttcttaggggaaccaaagcactaacagaagtagtaccactaacagaagaagcagagctagaactggcagaaaacagggagattctaaaagaaccggtacatggagtgtattatgacccatcaaaagacttaatagcagaaatacagaagcaggggcaaggccaatggacatatcaaatttatcaagagccatttaaaaatctgaaaacaggaaagtatgcaagaatgaacgaatctgccgttgccatatacagcatctgaacaagctgatcgaacccttcatggacggttaaggccgcctgttggtgggcggggatcaagcaggaatttggcattccctacaatccccaaagtcaaggagtaatagaatctatgaataaagaattaaagaaaattataggacaggtaagagatcaggctgaacatcttaagacagcagtacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggaaaggaccagcaaagctcctctggaaaggtgaaggggcagtagtaatacaagataatagtgacataaaagtagtgccaagaagaaaagcaaagatcatcagggattatggaaaacagatggcaggtgatgattgtgtggcaagtagacaggatgaggattaacacatggaaaagattagtaaaacaccatatgtatatttcaaggaaagctaaggactggttttatagacatcactatgaaagtactaatccaaaaataagttcagaagtacacatcccactaggggatgctaaattagtaataacaacatattggggtctgcatacaggagaaagagactggcatttgggtcagggagtctccatagaatggaggaaaaagagatatagcacacaagtagaccctgacctagcagaccaactaattcatctgcactattttgattgtttttcagaatctgctataagaaataccatattaggacgtatagttagtcctaggtgtgaatatcaagcaggacataacaaggtaggatctctacagtacttggcactagcagcattaataaaaccaaaacagataaagccacctttgcctagtgttaggaaactgacagaggacagatggaacaagccccagaagaccaagggccacagagggagccatacaatgaatggacactagagcttttagaggaacttaagagtgaagctgttagacattttcctaggatatggctccataacttaggacaacatatctatgaaacttacggggatacttgggcaggagtggaagccataataagaattctgcaacaactgctgtttatccatttcagaattgggtgtcgacatagcagaataggcgttactcgacagaggagagcaagaaatggagccagtagatcctagactagagccctggaagcatccaggaagtcagcctaaaactgcttgtaccaattgctattgtaaaaagtgttgctttcattgccaagtttgtttcatgacaaaagccttaggcatctcctatggcaggaagaagcggagacagcgacgaagagctcatcagaacagtcagactcatcaagcttctctatcaaagcagtaagtagtacatgtaatgcaacctataatagtagcaatagtagcattagtagtagcaataataatagcaatagttgtgtggtccatagtaatcatagaatataggaaaatattaagacaaagaaaaatagacaggttaattgatagactaatagaaagagcagaagacagtggcaatgagagtgaaggagaagtatcagcacttgtggagatgggggtggaaatggggcaccatgctccttgggatattgatgatctgtagtgctacagaaaaattgtgggtcacagtctattatggggtacctgtgtggaaggaagcaaccaccactctattttgtgcatcagatgctaaagcatatgatacagaggtacataatgtttgggccacacatgcctgtgtacccacagaccccaacccacaagaagtagtattggtaaatgtgacagaaaattttaacatgtggaaaaatgacatggtagaacagatgcatgaggatataatcagtttatgggatcaaagcctaaagccatgtgtaaaattaaccccactctgtgttagtttaaagtgcactgatttgaagaatgatactaataccaatagtagtagcgggagaatgataatggagaaaggagagataaaaaactgctctttcaatatcagcacaagcataagagataaggtgcagaaagaatatgcattcttttataaacttgatatagtaccaatagataataccagctataggttgataagttgtaacacctcagtcattacacaggcctgtccaaaggtatcctttgagccaattcccatacattattgtgccccggctggttttgcgattctaaaatgtaataataagacgttcaatggaacaggaccatgtacaaatgtcagcacagtacaatgtacacatggaatcaggccagtagtatcaactcaactgctgttaaatggcagtctagcagaagaagatgtagtaattagatctgccaatttcacagacaatgctaaaaccataatagtacagctgaacacatctgtagaaattaattgtacaagacccaacaacaatacaagaaaaagtatccgtatccagaggggaccagggagagcatttgttacaataggaaaaataggaaatatgagacaagcacattgtaacattagtagagcaaaatggaatgccactttaaaacagatagctagcaaattaagagaacaatttggaaataataaaacaataatctttaagcaatcctcaggaggggacccagaaattgtaacgcacagttttaattgtggaggggaatttttctactgtaattcaacacaactgtttaatagtacttggtttaatagtacttggagtactgaagggtcaaataacactgaaggaagtgacacaatcacactcccatgcagaataaaacaatttataaacatgtggcaggaagtaggaaaagcaatgtatgcccctcccatcagtggacaaattagatgttcatcaaatattactgggctgctattaacaagagatggtggtaataacaacaatgggtccgagatcttcagacctggaggaggcgatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctgatatagtgcagcagcagaacaatttgctgagggctattgaggcgcaacagcatctgttgcaactcacagtctggggcatcaaacagctccaggcaagaatcctggctgtggaaagatacctaaaggatcaacagctcctggggatttggggttgctctggaaaactcatttgcaccactgctgtgccttggaatgctagttggagtaataaatctctggaacagatttggaataacatgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaatcccgaggggacccgacaggcccgaaggaatagaagaagaaggtggagagagagacagagacagatccattcgattagtgaacggatccttagcacttatctgggacgatctgcggagcctgtgcctcttcagctaccaccgcttgagagacttactcttgattgtaacgaggattgtggaacttctgggacgcagggggtgggaagccctcaaatattggtggaatctcctacagtattggagtcaggaactaaagaatagtgctgttaacttgctcaatgccacagccatagcagtagctgaggggacagatagggttatagaagtattacaagcagcttatagagctattcgccacatacctagaagaataagacagggcttggaaaggattttgctataagatgggtggcaagtggtcaaaaagtagtgtgattggatggcctgctgtaagggaaagaatgagacgagctgagccagcagcagatggggtgggagcagtatctcgagacctagaaaaacatggagcaatcacaagtagcaatacagcagctaacaatgctgcttgtgcctggctagaagcacaagaggaggaagaggtgggttttccagtcacacctcaggtacctttaagaccaatgacttacaaggcagctgtagatcttagccactttttaaaagaaaaggggggactggaagggctaattcactcccaaagaagacaagatatccttgatctgtggatctaccacacacaaggctacttccctgattggcagaactacacaccagggccaggggtcagatatccactgacctttggatggtgctacaagctagtaccagttgagccagataaggtagaagaggccaataaaggagagaacaccagcttgttacaccctgtgagcctgcatggaatggatgaccctgagagagaagtgttagagtggaggtttgacagccgcctagcatttcatcacgtggcccgagagctgcatccggagtacttcaagaactgctgacatcgagcttgctacaagggactttccgctggggactttccagggaggcgtggcctgggcgggactggggagtggcgagccctcagatgctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagca

SEQ ID NO: 98 - DNA, 7017 bp, Artificial Sequence
  Synthetic Sequence
tggaagggctaatttggtcccaaaaaagacaagagatccttgatctgtggatctaccacacacaaggctacttccctgattggcagaactacacaccagggccagggatcagatatccactgacctttggatggtgcttcaagttagtaccagttgaaccagagcaagtagaagaggccaatgaaggagagaacaacagcttgttacaccctatgagccagcatgggatggaggacccggagggagaagtattagtgtggaagtttgacagcctcctagcatttcgtcacatggcccgagagctgcatccggagtactacaaagactgctgacatcgagctttctacaagggactttccgctggggactttccagggaggtgtggcctgggcgggactggggagtggcgagccctcagatgctacatataagcagctgctttttgcctgtactgggtctctctggttagaccagatctgagcctgggagctctctggctaactagggaacccactgcttaagcctcaataaagcttgccttgagtgctcaaagtagtgtgtgcccgtctgttgtgtgactctggtaactagagatccctcagacccttttagtcagtgtggaaaatctctagcagtggcgcccgaacagggacttgaaagcgaaagtaaagccagaggagatctctcgacgcaggactcggcttgctgaagcgcgcacggcaagaggcgaggggcggcgactggtgagtacgccaaaaattttgactagcggaggctagaaggagagagatgggtgcgagagcgtcggtattaagcgggggagaattagataaatgggaaaaaattcggttaaggccagggggaaagaaacaatataaactaaaacatatagtatgggcaagcagggagctagaacgattcgcagttaatcctggccttttagagacatcagaaggctgtagacaaatactgggacagctacaaccatcccttcagacaggatcagaagaacttagatcattatataatacaatagcagtcctctattgtgtgcatcaaaggatagatgtaaaagacaccaaggaagccttagataagatagaggaagagcaaaacaaaagtaagaaaaaggcacagcaagcagcagctgacacaggaaacaacagccaggtcagccaaaattaccctatagtgcagaacctccaggggcaaatggtacatcaggccatatcacctagaactttaaatgcatgggtaaaagtagtagaagagaaggctttcagcccagaagtaatacccatgttttcagcattatcagaaggagccaccccacaagatttaaataccatgctaaacacagtggggggacatcaagcagccatgcaaatgttaaaagagaccatcaatgaggaagctgcagaatgggatagattgcatccagtgcatgcagggcctattgcaccaggccaaacgaatctgccgttgccatatgcagacattacactgtcgaatcgaacccttcatggacggtggaaaccaaaaatgatagggggaattggaggttttatcaaagtaagacagtatgatcagatactcatagaaatctgcggacataaagctataggtacagtattagtaggacctacacctgtcaacataattggaagaaatctgttgactcagattggctgcactttaaattttcccattagtcctattgagactgtaccagtaaaattaaagccaggaatggatggcccaaaagttaaacaatggccattgacagaagaaaaaataaaagcattagtagaaatttgtacagaaatggaaaaggaaggaaaaatttcaaaaattgggcctgaaaatccatacaatactccagtatttgccataaagaaaaaagacagtactaaatggagaaaattagtagatttcagagaacttaataagagaactcaagatttctgggaagttcaattaggaataccacatcctgcagggttaaaacagaaaaaatcagtaacagtactggatgtgggcgatgcatatttttcagttcccttagataaagacttcaggaagtatactgcatttaccatacctagtataaacaatgagacaccagggattagatatcagtacaatgtgcttccacagggatggaaaggatcaccagcaatattccagtgtagcatgacaaaaatcttagagccttttagaaaacaaaatccagacatagtcatctatcaatacatggatgatttgtatgtaggatctgacttagaaatagggcagcatagaacaaaaatagaggaactgagacaacatctgttgaggtggggatttaccacaccagacaaaaaacatcagaaagaacctccattcctttggatgggttatgaactccatcctgataaatggacagtacagcctatagtgctgccagaaaaggacagctggactgtcaatgacatacagaaattagtgggaaaattgaattgggcaagtcagatttatgcagggattaaagtaaggcaattatgtaaacttcttaggggaaccaaagcactaacagaagtagtaccactaacagaagaagcagagctagaactggcagaaaacagggagattctaaaagaaccggtacatggagtgtattatgacccatcaaaagacttaatagcagaaatacagaagcaggggcaaggccaatggacatatcaaatttatcaagagccatttaaaaatctgaaaacaggaaagtatgcaagaatgaacgaatctgccgttgccatatacagcatctgaacaagctgatcgaacccttcatggacggttaaggccgcctgttggtgggcggggatcaagcaggaatttggcattccctacaatccccaaagtcaaggagtaatagaatctatgaataaagaattaaagaaaattataggacaggtaagagatcaggctgaacatcttaagacagcagtacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggaaaggaccagcaaagctcctctggaaaggtgaaggggcagtagtaatacaagataatagtgacataaaagtagtgccaagaagaaaagcaaagatcatcagggattatggaaaacagatggcaggtgatgattgtgtggcccgtccatgaagggttcgattcttgaacagcgcggtctgttatggcaacggcagattcgtttaatgcaacctataatagtagcaatagtagcattagtagtagcaataataatagcaatagttgtgtggtccatagtaatcatagaatataggaaaatattaagacaaagaaaaatagacaggttaattgatagactaatagaaagagcagaagacagtggcaatgagagtgaaggagaagtatcagcacttgtggagatgggggtggaaatggggcaccatgctccttgggatattgatgatctgtagtgctacagaaaaattgtgggtcacagtctattatggggtacctgtgtggaaggaagcaaccaccactctattttgtgcatcagatgctaaagcatatgatacagaggtacataatgtttgggccacacatgcctgtgtacccacagaccccaacccacaagaagtagtattggtaaatgtgacagaaaattttaacatgtggaaaaatgacatggtagaacagatgcatgaggatataatcagtttatgggatcaaagcctaaagccatgtgtaaaattaaccccactctgtgttagtttaaagtgcactgatttgaagaatgatactaataccaatagtagtagcgggagaatgataatggagaaaggagagataaaaaactgctctttcaatatcagcacaagcataagagataaggtgcagaaagaatatgcattcttttataaacttgatatagtaccaatagataataccagctataggttgataagttgtaacacctcagtcattacacaggcctgtccaaaggtatcctttgagccaattcccatacattattgtgccccggctggttttgcgattctaaaatgtaataataagacgttcaatggaacaggaccatgtacaaatgtcagcacagtacaatgtacacatggaatcaggccagtagtatcaactcaactgctgttaaatggcagtctagcagaagaagatgtagtaattagatctgccaatttcacagacaatgctaaaaccataatagtacagctgaacacatctgtagaaattaattgtacaagacccaacaacaatacaagaaaaagtatccgtatccagaggggaccagggagagcatttgttacaataggaaaaataggaaatatgagacaagcacattgtaacattagtagagcaaaatggaatgccactttaaaacagatagctagcaaattaagagaacaatttggaaataataaaacaataatctttaagcaatcctcaggaggggacccagaaattgtaacgcacagttttaattgtggaggggaatttttctactgtaattcaacacaactgtttaatagtacttggtttaatagtacttggagtactgaagggtcaaataacactgaaggaagtgacacaatcacactcccatgcagaataaaacaatttataaacatgtggcaggaagtaggaaaagcaatgtatgcccctcccatcagtggacaaattagatgttcatcaaatattactgggctgctattaacaagagatggtggtaataacaacaatgggtccgagatcttcagacctggaggaggcgatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctgatatagtgcagcagcagaacaatttgctgagggctattgaggcgcaacagcatctgttgcaactcacagtctggggcatcaaacagctccaggcaagaatcctggctgtggaaagatacctaaaggatcaacagctcctggggatttggggttgctctggaaaactcatttgcaccactgctgtgccttggaatgctagttggagtaataaatctctggaacagatttggaataacatgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaatcccgaggggacccgacaggcccgaaggaatagaagaagaaggtggagagagagacagagacagatccattcgattagtgaacggatccttagcacttatctgggacgatctgcggagcctgtgcctcttcagctaccaccgcttgagagacttactcttgattgtaacgaggattgtggaacttctgggacgcagggggtgggaagccctcaaatattggtggaatctcctacagtattggagtcaggaactaaagaatagtgctgttaacttgctcaatgccacagccatagcagtagctgaggggacagatagggttatagaagtattacaagcagcttatagagctattcgccacatacctagaagaataagacagggcttggaaaggattttgctataagatgggtggcaagtggtcaaaaagtagtgtgattggatggcctgctgtaagggaaagaatgagacgagctgagccagcagcagatggggtgggagcagtatctcgagacctagaaaaacatggagcaatcacaagtagcaatacagcagctaacaatgctgcttgtgcctggctagaagcacaagaggaggaagaggtgggttttccagtcacacctcaggtacctttaagaccaatgacttacaaggcagctgtagatcttagccactttttaaaagaaaaggggggactggaagggctaattcactcccaaagaagacaagatatccttgatctgtggatctaccacacacaaggctacttccctgattggcagaactacacaccagggccaggggtcagatatccactgacctttggatggtgctacaagctagtaccagttgagccagataaggtagaagaggccaataaaggagagaacaccagcttgttacaccctgtgagcctgcatggaatggatgaccctgagagagaagtgttagagtggaggtttgacagccgcctagcatttcatcacgtggcccgagagctgcatccggagtacttcaagaactgctgacatcgagcttgctacaagggactttccgctggggactttccagggaggcgtggcctgggcgggactggggagtggcgagccctcagatgctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagca

SEQ ID NO: 99 - DNA, 6792 bp, Artificial Sequence
  Synthetic Sequence
tggaagggctaatttggtcccaaaaaagacaagagatccttgatctgtggatctaccacacacaaggctacttccctgattggcagaactacacaccagggccagggatcagatatccactgacctttggatggtgcttcaagttagtaccagttgaaccagagcaagtagaagaggccaatgaaggagagaacaacagcttgttacaccctatgagccagcatgggatggaggacccggagggagaagtattagtgtggaagtttgacagcctcctagcatttcgtcacatggcccgagagctgcatccggagtactacaaagactgctgacatcgagctttctacaagggactttccgctggggactttccagggaggtgtggcctgggcgggactggggagtggcgagccctcagatgctacatataagcagctgctttttgcctgtactgggtctctctggttagaccagatctgagcctgggagctctctggctaactagggaacccactgcttaagcctcaataaagcttgccttgagtgctcaaagtagtgtgtgcccgtctgttgtgtgactctggtaactagagatccctcagacccttttagtcagtgtggaaaatctctagcagtggcgcccgaacagggacttgaaagcgaaagtaaagccagaggagatctctcgacgcaggactcggcttgctgaagcgcgcacggcaagaggcgaggggcggcgactggtgagtacgccaaaaattttgactagcggaggctagaaggagagagatgggtgcgagagcgtcggtattaagcgggggagaattagataaatgggaaaaaattcggttaaggccagggggaaagaaacaatataaactaaaacatatagtatgggcaagcagggagctagaacgattcgcagttaatcctggccttttagagacatcagaaggctgtagacaaatactgggacagctacaaccatcccttcagacaggatcagaagaacttagatcattatataatacaatagcagtcctctattgtgtgcatcaaaggatagatgtaaaagacaccaaggaagccttagataagatagaggaagagcaaaacaaaagtaagaaaaaggcacagcaagcagcagctgacacaggaaacaacagccaggtcagccaaaattaccctatagtgcagaacctccaggggcaaatggtacatcaggccatatcacctagaactttaaatgcatgggtaaaagtagtagaagagaaggctttcagcccagaagtaatacccatgttttcagcattatcagaaggagccaccccacaagatttaaataccatgctaaacacagtggggggacatcaagcagccatgcaaatgttaaaagagaccatcaatgaggaagctgcagaatgggatagattgcatccagtgcatgcagggcctattgcaccaggccaaacgaatctgccgttgccatatgcagacattacactgtcgaatcgaacccttcatggacggtggaaaccaaaaatgatagggggaattggaggttttatcaaagtaagacagtatgatcagatactcatagaaatctgcggacataaagctataggtacagtattagtaggacctacacctgtcaacataattggaagaaatctgttgactcagattggctgcactttaaattttcccattagtcctattgagactgtaccagtaaaattaaagccaggaatggatggcccaaaagttaaacaatggccattgacagaagaaaaaataaaagcattagtagaaatttgtacagaaatggaaaaggaaggaaaaatttcaaaaattgggcctgaaaatccatacaatactccagtatttgccataaagaaaaaagacagtactaaatggagaaaattagtagatttcagagaacttaataagagaactcaagatttctgggaagttcaattaggaataccacatcctgcagggttaaaacagaaaaaatcagtaacagtactggatgtgggcgatgcatatttttcagttcccttagataaagacttcaggaagtatactgcatttaccatacctagtataaacaatgagacaccagggattagatatcagtacaatgtgcttccacagggatggaaaggatcaccagcaatattccagtgtagcatgacaaaaatcttagagccttttagaaaacaaaatccagacatagtcatctatcaatacatggatgatttgtatgtaggatctgacttagaaatagggcagcatagaacaaaaatagaggaactgagacaacatctgttgaggtggggatttaccacaccagacaaaaaacatcagaaagaacctccattcctttggatgggttatgaactccatcctgataaatggacagtacagcctatagtgctgccagaaaaggacagctggactgtcaatgacatacagaaattagtgggaaaattgaattgggcaagtcagatttatgcagggattaaagtaaggcaattatgtaaacttcttaggggaaccaaagcactaacagaagtagtaccactaacagaagaagcagagctagaactggcagaaaacagggagattctaaaagaaccggtacatggagtgtattatgacccatcaaaagacttaatagcagaaatacagaagcaggggcaaggccaatggacatatcaaatttatcaagagccatttaaaaatctgaaaacaggaaagtatgcaagaatgaacgaatctgccgttgccatatacagcatctgaacaagctgatcgaacccttcatggacggttaaggccgcctgttggtgggcggggatcaagcaggaatttggcattccctacaatccccaaagtcaaggagtaatagaatctatgaataaagaattaaagaaaattataggacaggtaagagatcaggctgaacatcttaagacagcagtacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggaaaggaccagcaaagctcctctggaaaggtgaaggggcagtagtaatacaagataatagtgacataaaagtagtgccaagaagaaaagcaaagatcatcagggattaaccgtccatgaagggttcgattatctgtagccaacattcgatatggcaacggcagattcgttggagatgggggtggaaatggggcaccatgctccttgggatattgatgatctgtagtgctacagaaaaattgtgggtcacagtctattatggggtacctgtgtggaaggaagcaaccaccactctattttgtgcatcagatgctaaagcatatgatacagaggtacataatgtttgggccacacatgcctgtgtacccacagaccccaacccacaagaagtagtattggtaaatgtgacagaaaattttaacatgtggaaaaatgacatggtagaacagatgcatgaggatataatcagtttatgggatcaaagcctaaagccatgtgtaaaattaaccccactctgtgttagtttaaagtgcactgatttgaagaatgatactaataccaatagtagtagcgggagaatgataatggagaaaggagagataaaaaactgctctttcaatatcagcacaagcataagagataaggtgcagaaagaatatgcattcttttataaacttgatatagtaccaatagataataccagctataggttgataagttgtaacacctcagtcattacacaggcctgtccaaaggtatcctttgagccaattcccatacattattgtgccccggctggttttgcgattctaaaatgtaataataagacgttcaatggaacaggaccatgtacaaatgtcagcacagtacaatgtacacatggaatcaggccagtagtatcaactcaactgctgttaaatggcagtctagcagaagaagatgtagtaattagatctgccaatttcacagacaatgctaaaaccataatagtacagctgaacacatctgtagaaattaattgtacaagacccaacaacaatacaagaaaaagtatccgtatccagaggggaccagggagagcatttgttacaataggaaaaataggaaatatgagacaagcacattgtaacattagtagagcaaaatggaatgccactttaaaacagatagctagcaaattaagagaacaatttggaaataataaaacaataatctttaagcaatcctcaggaggggacccagaaattgtaacgcacagttttaattgtggaggggaatttttctactgtaattcaacacaactgtttaatagtacttggtttaatagtacttggagtactgaagggtcaaataacactgaaggaagtgacacaatcacactcccatgcagaataaaacaatttataaacatgtggcaggaagtaggaaaagcaatgtatgcccctcccatcagtggacaaattagatgttcatcaaatattactgggctgctattaacaagagatggtggtaataacaacaatgggtccgagatcttcagacctggaggaggcgatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctgatatagtgcagcagcagaacaatttgctgagggctattgaggcgcaacagcatctgttgcaactcacagtctggggcatcaaacagctccaggcaagaatcctggctgtggaaagatacctaaaggatcaacagctcctggggatttggggttgctctggaaaactcatttgcaccactgctgtgccttggaatgctagttggagtaataaatctctggaacagatttggaataacatgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaatcccgaggggacccgacaggcccgaaggaatagaagaagaaggtggagagagagacagagacagatccattcgattagtgaacggatccttagcacttatctgggacgatctgcggagcctgtgcctcttcagctaccaccgcttgagagacttactcttgattgtaacgaggattgtggaacttctgggacgcagggggtgggaagccctcaaatattggtggaatctcctacagtattggagtcaggaactaaagaatagtgctgttaacttgctcaatgccacagccatagcagtagctgaggggacagatagggttatagaagtattacaagcagcttatagagctattcgccacatacctagaagaataagacagggcttggaaaggattttgctataagatgggtggcaagtggtcaaaaagtagtgtgattggatggcctgctgtaagggaaagaatgagacgagctgagccagcagcagatggggtgggagcagtatctcgagacctagaaaaacatggagcaatcacaagtagcaatacagcagctaacaatgctgcttgtgcctggctagaagcacaagaggaggaagaggtgggttttccagtcacacctcaggtacctttaagaccaatgacttacaaggcagctgtagatcttagccactttttaaaagaaaaggggggactggaagggctaattcactcccaaagaagacaagatatccttgatctgtggatctaccacacacaaggctacttccctgattggcagaactacacaccagggccaggggtcagatatccactgacctttggatggtgctacaagctagtaccagttgagccagataaggtagaagaggccaataaaggagagaacaccagcttgttacaccctgtgagcctgcatggaatggatgaccctgagagagaagtgttagagtggaggtttgacagccgcctagcatttcatcacgtggcccgagagctgcatccggagtacttcaagaactgctgacatcgagcttgctacaagggactttccgctggggactttccagggaggcgtggcctgggcgggactggggagtggcgagccctcagatgctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagca

SEQ ID NO: 100 - DNA, 8947 bp, Artificial Sequence
  Synthetic Sequence
tggaagggctaatttggtcccaaaaaagacaagagatccttgatctgtggatctaccacacacaaggctacttccctgattggcagaactacacaccagggccagggatcagatatccactgacctttggatggtgcttcaagttagtaccagttgaaccagagcaagtagaagaggccaatgaaggagagaacaacagcttgttacaccctatgagccagcatgggatggaggacccggagggagaagtattagtgtggaagtttgacagcctcctagcatttcgtcacatggcccgagagctgcatccggagtactacaaagactgctgacatcgagctttctacaagggactttccgctggggactttccagggaggtgtggcctgggcgggactggggagtggcgagccctcagatgctacatataagcagctgctttttgcctgtactgggtctctctggttagaccagatctgagcctgggagctctctggctaactagggaacccactgcttaagcctcaataaagcttgccttgagtgctcaaagtagtgtgtgcccgtctgttgtgtgactctggtaactagagatccctcagacccttttagtcagtgtggaaaatctctagcagtggcgcccgaacagggacttgaaagcgaaagtaaagccagaggagatctctcgacgcaggactcggcttgctgaagcgcgcacggcaagaggcgaggggcggcgactggtgagtacgccaaaaattttgactagcggaggctagaaggagagagatgggtgcgagagcgtcggtattaagcgggggagaattagataaatgggaaaaaattcggttaaggccagggggaaagaaacaatataaactaaaacatatagtatgggcaagcagggagctagaacgattcgcagttaatcctggccttttagagacatcagaaggctgtagacaaatactgggacagctacaaccatcccttcagacaggatcagaagaacttagatcattatataatacaatagcagtcctctattgtgtgcatcaaaggatagatgtaaaagacaccaaggaagccttagataagatagaggaagagcaaaacaaaagtaagaaaaaggcacagcaagcagcagctgacacaggaaacaacagccaggtcagccaaaattaccctatagtgcagaacctccaggggcaaatggtacatcaggccatatcacctagaactttaaatgcatgggtaaaagtagtagaagagaaggctttcagcccagaagtaatacccatgttttcagcattatcagaaggagccaccccacaagatttaaataccatgctaaacacagtggggggacatcaagcagccatgcaaatgttaaaagagaccatcaatgaggaagctgcagaatgggatagattgcatccagtgcatgcagggcctattgcaccaggccagatgagagaaccaagaccgtccatgaagggttcgatggggggcggcgattacttgttatggcaacggcagattcgttaaaggaagctctattagatacaggagcagatgatacagtattagaagaaatgaatttgccaggaagatggaaaccaaaaatgatagggggaattggaggttttatcaaagtaagacagtatgatcagatactcatagaaatctgcggacataaagctataggtacagtattagtaggacctacacctgtcaacataattggaagaaatctgttgactcagattggctgcactttaaattttcccattagtcctattgagactgtaccagtaaaattaaagccaggaatggatggcccaaaagttaaacaatggccattgacagaagaaaaaataaaagcattagtagaaatttgtacagaaatggaaaaggaaggaaaaatttcaaaaattgggcctgaaaatccatacaatactccagtatttgccataaagaaaaaagacagtactaaatggagaaaattagtagatttcagagaacttaataagagaactcaagatttctgggaagttcaattaggaataccacatcctgcagggttaaaacagaaaaaatcagtaacagtactggatgtgggcgatgcatatttttcagttcccttagataaagacttcaggaagtatactgcatttaccatacctagtataaacaatgagacaccagggattagatatcagtacaatgtgcttccacagggatggaaaggatcaccagcaatattccagtgtagcatgacaaaaatcttagagccttttagaaaacaaaatccagacatagtcatctatcaatacatggatgatttgtatgtaggatctgacttagaaatagggcagcatagaacaaaaatagaggaactgagacaacatctgttgaggtggggatttaccacaccagacaaaaaacatcagaaagaacctccattcctttggatgggttatgaactccatcctgataaatggacagtacagcctatagtgctgccagaaaaggacagctggactgtcaatgacatacagaaattagtgggaaaattgaattgggcaagtcagatttatgcagggattaaagtaaggcaattatgtaaacttcttaggggaaccaaagcactaacagaagtagtaccactaacagaagaagcagagctagaactggcagaaaacagggagattctaaaagaaccggtacatggagtgtattatgacccatcaaaagacttaatagcagaaatacagaagcaggggcaaggccaatggacatatcaaatttatcaagagccatttaaaaatctgaaaacaggaaagtatgcaagaatgaagggtgcccacactaatgatgtgaaacaattaacagaggcagtacaaaaaatagccacagaaagcatagtaatatggggaaagactcctaaatttaaattacccatacaaaaggaaacatgggaagcatggtggacagagtattggcaagccacctggattcctgagtgggagtttgtcaatacccctcccttagtgaagttatggtaccagttagagaaagaacccataataggagcagaaactttctatgtagatggggcagccaatagggaaactaaattaggaaaagcaggatatgtaactgacagaggaagacaaaaagttgtccccctaacggacacaacaaatcagaagactgagttacaagcaattcatctagctttgcaggattcgggattagaagtaaacatagtgacagactcacaatatgcattgggaatcattcaagcacaaccagataagagtgaatcagagttagtcagtcaaataatagagcagttaataaaaaaggaaaaagtctacctggcatgggtaccagcacacaaaggaattggaggaaatgaacaagtagataaattggtcagtgctggaatcaggaaagtactatttttagatggaatagataaggcccaagaagaacatgagaaatatcacagtaattggagagcaatggctagtgattttaacctaccacctgtagtagcaaaagaaatagtagccagctgtgataaatgtcagctaaaaggggaagccatgcatggacaagtagactgtagcccaggaatatggcagctagattgtacacatttagaaggaaaagttatcttggtagcagttcatgtagccagtggatatatagaagcagaagtaattccagcagagacagggcaagaaacagcatacttcctcttaaaattagcaggaagatggccagtaaaaacagtacatacagacaatggcagcaatttcaccagtactacagttaaggccgcctgttggtgggcggggatcaagcaggaatttggcattccctacaatccccaaagtcaaggagtaatagaatctatgaataaagaattaaagaaaattataggacaggtaagagatcaggctgaacatcttaagacagcagtacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggaaaggaccagcaaagctcctctggaaaggtgaaggggcagtagtaatacaagataatagtgacataaaagtagtgccaagaagaaaagcaaagatcatcagggattatggaaaacagatggcaggtgatgattgtgtggcaagtagacaggatgaggattaacacatggaaaagattagtaaaacaccatatgtatatttcaaggaaagctaaggactggttttatagacatcactatgaaagtactaatccaaaaataagttcagaagtacacatcccactaggggatgctaaattagtaataacaacatattggggtctgcatacaggagaaagagactggcatttgggtcagggagtctccatagaatggaggaaaaagagatatagcacacaagtagaccctgacctagcagaccaactaattcatctgcactattttgattgtttttcagaatctgctataagaaataccatattaggacgtatagttagtcctaggtgtgaatatcaagcaggacataacaaggtaggatctctacagtacttggcactagcagcattaataaaaccaaaacagataaagccacctttgcctagtgttaggaaactgacagaggacagatggaacaagccccagaagaccaagggccacagagggagccatacaatgaatggacactagagcttttagaggaacttaagagtgaagctgttagacattttcctaggatatggctccataacttaggacaacatatctatgaaacttacggggatacttgggcaggagtggaagccataataagaattctgcaacaactgctgtttatccatttcagaattgggtgtcgacatagcagaataggcgttactcgacagaggagagcaagaaatggagccagtagatcctagactagagccctggaagcatccaggaagtcagcctaaaactgcttgtaccaattgctattgtaaaaagtgttgctttcattgccaagtttgtttcatgacaaaagccttaggcatctcctatggcaggaagaagcggagacagcgacgaagagctcatcagaacagtcagactcatcaagcttctctatcaaagcagtaagtagtacatgtaatgcaacctataatagtagcaatagtagcattagtagtagcaataataatagcaatagttgtgtggtccatagtaatcatagaatataggaaaatattaagacaaagaaaaatagacaggttaattgatagactaatagaaagagcagaagacagtggcaatgagagtgaaggagaagtatcagcacttgtggagatgggggtggaaatggggcaccatgctccttgggatattgatgatctgtagtgctacagaaaaattgtgggtcacagtctattatggggtacctgtgtggaaggaagcaaccaccactctattttgtgcatcagatgctaaagcatatgatacagaggtacataatgtttgggccacacatgcctgtgtacccacagaccccaacccacaagaagtagtattggtaaatgtgacagaaaattttaacatgtggaaaaatgacatggtagaacagatgcatgaggatataatcagtttatgggatcaaagcctaaagccatgtgtaaaattaaccccactctgtgttagtttaaagtgcactgatttgaagaatgatactaataccaatagtagtagcgggagaatgataatggagaaaggagagataaaaaactgctctttcaatatcagcacaagcataagagataaggtgcagaaagaatatgcattcttttataaacttgatatagtaccaatagataataccagctataggttgataagttgtaacacctcagtcattacacaggcctgtccaaaggtatcctttgagccaattcccatacattattgtgccccggctggttttgcgattctaaaatgtaataataagacgttcaatggaacaggaccatgtacaaatgtcagcacagtacaatgtacacatggaatcaggccagtagtatcaactcaactgctgttaaatggcagtctagcagaagaagatgtagtaattagatctgccaatttcacagacaatgctaaaaccataatagtacagctgaacacatctgtagaaattaattgtacaagacccaacaacaatacaagaaaaagtatccgtatccagaggggaccagggagagcatttgttacaataggaaaaataggaaatatgagacaagcacattgtaacattagtagagcaaaatggaatgccactttaaaacagatagctagcaaattaagagaacaatttggaaataataaaacaataatctttaagcaatcctcaggaggggacccagaaattgtaacgcacagttttaattgtggaggggaatttttctactgtaattcaacacaactgtttaatagtacttggtttaatagtacttggagtactgaagggtcaaataacactgaaggaagtgacacaatcacactcccatgcagaataaaacaatttataaacatgtggcaggaagtaggaaaagcaatgtatgcccctcccatcagtggacaaattagatgttcatcaaatattactgggctgctattaacaagagatggtggtaataacaacaatgggtccgagatcttcagacctggaggaggcgatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctgatatagtgcagcagcagaacaatttgctgagggctattgaggcgcaacagcatctgttgcaactcacagtctggggcatcaaacagctccaggcaagaatcctggctgtggaaagatacctaaaggatcaacagctcctggggatttggggttgctctggaaaactcatttgcaccactgctgtgccttggaatgctagttggagtaataaatctctggaacagatttggaataacatgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaatcccgaggggacccgacaggcccgaaggaatagaagaagaaggtggagagagagacagagacagatccattcgattagtgaacggatccttagcacttatctgggacgatctgcggagcctgtgcctcttcagctaccaccgcttgagagacttactcttgattgtaacgaggattgtggaacttctgggacgcagggggtgggaagccctcaaatattggtggaatctcctacagtattggagtcaggaactaaagaatagtgctgttaacttgctcaatgccacagccatagcagtagctgaggggacagatagggttatagaagtattacaagcagcttatagagctattcgccacatacctagaagaataagacagggcttggaaaggattttgctataagatgggtggcaagtggtcaaaaagtagtgtgattggatggcctgctgtaagggaaagaatgagacgagctgagccagcagcagatggggtgggagcagtatctcgagacctagaaaaacatggagcaatcacaagtagcaatacagcagctaacaatgctgcttgtgcctggctagaagcacaagaggaggaagaggtgggttttccagtcacacctcaggtacctttaagaccaatgacttacaaggcagctgtagatcttagccactttttaaaagaaaaggggggactggaagggctaattcactcccaaagaagacaagatatccttgatctgtggatctaccacacacaaggctacttccctgattggcagaactacacaccagggccaggggtcagatatccactgacctttggatggtgctacaagctagtaccagttgagccagataaggtagaagaggccaataaaggagagaacaccagcttgttacaccctgtgagcctgcatggaatggatgaccctgagagagaagtgttagagtggaggtttgacagccgcctagcatttcatcacgtggcccgagagctgcatccggagtacttcaagaactgctgacatcgagcttgctacaagggactttccgctggggactttccagggaggcgtggcctgggcgggactggggagtggcgagccctcagatgctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagca

SEQ ID NO: 101 - DNA, 8024 bp, Artificial Sequence
  Synthetic Sequence
tggaagggctaatttggtcccaaaaaagacaagagatccttgatctgtggatctaccacacacaaggctacttccctgattggcagaactacacaccagggccagggatcagatatccactgacctttggatggtgcttcaagttagtaccagttgaaccagagcaagtagaagaggccaatgaaggagagaacaacagcttgttacaccctatgagccagcatgggatggaggacccggagggagaagtattagtgtggaagtttgacagcctcctagcatttcgtcacatggcccgagagctgcatccggagtactacaaagactgctgacatcgagctttctacaagggactttccgctggggactttccagggaggtgtggcctgggcgggactggggagtggcgagccctcagatgctacatataagcagctgctttttgcctgtactgggtctctctggttagaccagatctgagcctgggagctctctggctaactagggaacccactgcttaagcctcaataaagcttgccttgagtgctcaaagtagtgtgtgcccgtctgttgtgtgactctggtaactagagatccctcagacccttttagtcagtgtggaaaatctctagcagtggcgcccgaacagggacttgaaagcgaaagtaaagccagaggagatctctcgacgcaggactcggcttgctgaagcgcgcacggcaagaggcgaggggcggcgactggtgagtacgccaaaaattttgactagcggaggctagaaggagagagatgggtgcgagagcgtcggtattaagcgggggagaattagataaatgggaaaaaattcggttaaggccagggggaaagaaacaatataaactaaaacatatagtatgggcaagcagggagctagaacgattcgcagttaatcctggccttttagagacatcagaaggctgtagacaaatactgggacagctacaaccatcccttcagacaggatcagaagaacttagatcattatataatacaatagcagtcctctattgtgtgcatcaaaggatagatgtaaaagacaccaaggaagccttagataagatagaggaagagcaaaacaaaagtaagaaaaaggcacagcaagcagcagctgacacaggaaacaacagccaggtcagccaaaattaccctatagtgcagaacctccaggggcaaatggtacatcaggccatatcacctagaactttaaatgcatgggtaaaagtagtagaagagaaggctttcagcccagaagtaatacccatgttttcagcattatcagaaggagccaccccacaagatttaaataccatgctaaacacagtggggggacatcaagcagccatgcaaatgttaaaagagaccatcaatgaggaagctgcagaatgggatagattgcatccagtgcatgcagggcctattgcaccaggccagatgagagaaccaagaccgtccatgaagggttcgatggggggcggcgattacttgttatggcaacggcagattcgttaaaggaagctctattagatacaggagcagatgatacagtattagaagaaatgaatttgccaggaagatggaaaccaaaaatgatagggggaattggaggttttatcaaagtaagacagtatgatcagatactcatagaaatctgcggacataaagctataggtacagtattagtaggacctacacctgtcaacataattggaagaaatctgttgactcagattggctgcactttaaattttcccattagtcctattgagactgtaccagtaaaattaaagccaggaatggatggcccaaaagttaaacaatggccattgacagaagaaaaaataaaagcattagtagaaatttgtacagaaatggaaaaggaaggaaaaatttcaaaaattgggcctgaaaatccatacaatactccagtatttgccataaagaaaaaagacagtactaaatggagaaaattagtagatttcagagaacttaataagagaactcaagatttctgggaagttcaattaggaataccacatcctgcagggttaaaacagaaaaaatcagtaacagtactggatgtgggcgatgcatatttttcagttcccttagataaagacttcaggaagtatactgcatttaccatacctagtataaacaatgagacaccagggattagatatcagtacaatgtgcttccacagggatggaaaggatcaccagcaatattccagtgtagcatgacaaaaatcttagagccttttagaaaacaaaatccagacatagtcatctatcaatacatggatgatttgtatgtaggatctgacttagaaatagggcagcatagaacaaaaatagaggaactgagacaacatctgttgaggtggggatttaccacaccagacaaaaaacatcagaaagaacctccattcctttggatgggttatgaactccatcctgataaatggacagtacagcctatagtgctgccagaaaaggacagctggactgtcaatgacatacagaaattagtgggaaaattgaattgggcaagtcagatttatgcagggattaaagtaaggcaattatgtaaacttcttaggggaaccaaagcactaacagaagtagtaccactaacagaagaagcagagctagaactggcagaaaacagggagattctaaaagaaccggtacatggagtgtattatgacccatcaaaagacttaatagcagaaatacagaagcaggggcaaggccaatggacatatcaaatttatcaagagccatttaaaaatctgaaaacaggaaagtatgcaagaatgaagggtgcccacactaatgatgtgaaacaattaacagaggcagtacaaaaaatagccacagaaagcatagtaatatggggaaagactcctaaatttaaattacccatacaaaaggaaacatgggaagcatggtggacagagtattggcaagccacctggattcctgagtgggagtttgtcaatacccctcccttagtgaagttatggtaccagttagagaaagaacccataataggagcagaaactttctatgtagatggggcagccaatagggaaactaaattaggaaaagcaggatatgtaactgacagaggaagacaaaaagttgtccccctaacggacacaacaaatcagaagactgagttacaagcaattcatctagctttgcaggattcgggattagaagtaaacatagtgacagactcacaatatgcattgggaatcattcaagcacaaccagataagagtgaatcagagttagtcagtcaaataatagagcagttaataaaaaaggaaaaagtctacctggcatgggtaccagcacacaaaggaattggaggaaatgaacaagtagataaattggtcagtgctggaatcaggaaagtactatttttagatggaatagataaggcccaagaagaacatgagaaatatcacagtaattggagagcaatggctagtgattttaacctaccacctgtagtagcaaaagaaatagtagccagctgtgataaatgtcagctaaaaggggaagccatgcatggacaagtagactgtagcccaggaatatggcagctagattgtacacatttagaaggaaaagttatcttggtagcagttcatgtagccagtggatatatagaagcagaagtaattccagcagagacagggcaagaaacagcatacttcctcttaaaattagcaggaagatggccagtaaaaacagtacatacagacaatggcagcaatttcaccagtactacagttaaggccgcctgttggtgggcggggatcaagcaggaatttggcattccctacaatccccaaagtcaaggagtaatagaatctatgaataaagaattaaagaaaattataggacaggtaagagatcaggctgaacatcttaagacagcagtacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggaaaggaccagcaaagctcctctggaaaggtgaaggggcagtagtaatacaagataatagtgacataaaagtagtgccaagaagaaaagcaaagatcatcagggattatggaaaacagatggcaggtgatgattgtgtggcccgtccatgaagggttcgattcttgaacagcgcggtctgttatggcaacggcagattcgtttaatgcaacctataatagtagcaatagtagcattagtagtagcaataataatagcaatagttgtgtggtccatagtaatcatagaatataggaaaatattaagacaaagaaaaatagacaggttaattgatagactaatagaaagagcagaagacagtggcaatgagagtgaaggagaagtatcagcacttgtggagatgggggtggaaatggggcaccatgctccttgggatattgatgatctgtagtgctacagaaaaattgtgggtcacagtctattatggggtacctgtgtggaaggaagcaaccaccactctattttgtgcatcagatgctaaagcatatgatacagaggtacataatgtttgggccacacatgcctgtgtacccacagaccccaacccacaagaagtagtattggtaaatgtgacagaaaattttaacatgtggaaaaatgacatggtagaacagatgcatgaggatataatcagtttatgggatcaaagcctaaagccatgtgtaaaattaaccccactctgtgttagtttaaagtgcactgatttgaagaatgatactaataccaatagtagtagcgggagaatgataatggagaaaggagagataaaaaactgctctttcaatatcagcacaagcataagagataaggtgcagaaagaatatgcattcttttataaacttgatatagtaccaatagataataccagctataggttgataagttgtaacacctcagtcattacacaggcctgtccaaaggtatcctttgagccaattcccatacattattgtgccccggctggttttgcgattctaaaatgtaataataagacgttcaatggaacaggaccatgtacaaatgtcagcacagtacaatgtacacatggaatcaggccagtagtatcaactcaactgctgttaaatggcagtctagcagaagaagatgtagtaattagatctgccaatttcacagacaatgctaaaaccataatagtacagctgaacacatctgtagaaattaattgtacaagacccaacaacaatacaagaaaaagtatccgtatccagaggggaccagggagagcatttgttacaataggaaaaataggaaatatgagacaagcacattgtaacattagtagagcaaaatggaatgccactttaaaacagatagctagcaaattaagagaacaatttggaaataataaaacaataatctttaagcaatcctcaggaggggacccagaaattgtaacgcacagttttaattgtggaggggaatttttctactgtaattcaacacaactgtttaatagtacttggtttaatagtacttggagtactgaagggtcaaataacactgaaggaagtgacacaatcacactcccatgcagaataaaacaatttataaacatgtggcaggaagtaggaaaagcaatgtatgcccctcccatcagtggacaaattagatgttcatcaaatattactgggctgctattaacaagagatggtggtaataacaacaatgggtccgagatcttcagacctggaggaggcgatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctgatatagtgcagcagcagaacaatttgctgagggctattgaggcgcaacagcatctgttgcaactcacagtctggggcatcaaacagctccaggcaagaatcctggctgtggaaagatacctaaaggatcaacagctcctggggatttggggttgctctggaaaactcatttgcaccactgctgtgccttggaatgctagttggagtaataaatctctggaacagatttggaataacatgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaatcccgaggggacccgacaggcccgaaggaatagaagaagaaggtggagagagagacagagacagatccattcgattagtgaacggatccttagcacttatctgggacgatctgcggagcctgtgcctcttcagctaccaccgcttgagagacttactcttgattgtaacgaggattgtggaacttctgggacgcagggggtgggaagccctcaaatattggtggaatctcctacagtattggagtcaggaactaaagaatagtgctgttaacttgctcaatgccacagccatagcagtagctgaggggacagatagggttatagaagtattacaagcagcttatagagctattcgccacatacctagaagaataagacagggcttggaaaggattttgctataagatgggtggcaagtggtcaaaaagtagtgtgattggatggcctgctgtaagggaaagaatgagacgagctgagccagcagcagatggggtgggagcagtatctcgagacctagaaaaacatggagcaatcacaagtagcaatacagcagctaacaatgctgcttgtgcctggctagaagcacaagaggaggaagaggtgggttttccagtcacacctcaggtacctttaagaccaatgacttacaaggcagctgtagatcttagccactttttaaaagaaaaggggggactggaagggctaattcactcccaaagaagacaagatatccttgatctgtggatctaccacacacaaggctacttccctgattggcagaactacacaccagggccaggggtcagatatccactgacctttggatggtgctacaagctagtaccagttgagccagataaggtagaagaggccaataaaggagagaacaccagcttgttacaccctgtgagcctgcatggaatggatgaccctgagagagaagtgttagagtggaggtttgacagccgcctagcatttcatcacgtggcccgagagctgcatccggagtacttcaagaactgctgacatcgagcttgctacaagggactttccgctggggactttccagggaggcgtggcctgggcgggactggggagtggcgagccctcagatgctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagca

SEQ ID NO: 102 - DNA, 7799 bp, Artificial Sequence
  Synthetic Sequence
tggaagggctaatttggtcccaaaaaagacaagagatccttgatctgtggatctaccacacacaaggctacttccctgattggcagaactacacaccagggccagggatcagatatccactgacctttggatggtgcttcaagttagtaccagttgaaccagagcaagtagaagaggccaatgaaggagagaacaacagcttgttacaccctatgagccagcatgggatggaggacccggagggagaagtattagtgtggaagtttgacagcctcctagcatttcgtcacatggcccgagagctgcatccggagtactacaaagactgctgacatcgagctttctacaagggactttccgctggggactttccagggaggtgtggcctgggcgggactggggagtggcgagccctcagatgctacatataagcagctgctttttgcctgtactgggtctctctggttagaccagatctgagcctgggagctctctggctaactagggaacccactgcttaagcctcaataaagcttgccttgagtgctcaaagtagtgtgtgcccgtctgttgtgtgactctggtaactagagatccctcagacccttttagtcagtgtggaaaatctctagcagtggcgcccgaacagggacttgaaagcgaaagtaaagccagaggagatctctcgacgcaggactcggcttgctgaagcgcgcacggcaagaggcgaggggcggcgactggtgagtacgccaaaaattttgactagcggaggctagaaggagagagatgggtgcgagagcgtcggtattaagcgggggagaattagataaatgggaaaaaattcggttaaggccagggggaaagaaacaatataaactaaaacatatagtatgggcaagcagggagctagaacgattcgcagttaatcctggccttttagagacatcagaaggctgtagacaaatactgggacagctacaaccatcccttcagacaggatcagaagaacttagatcattatataatacaatagcagtcctctattgtgtgcatcaaaggatagatgtaaaagacaccaaggaagccttagataagatagaggaagagcaaaacaaaagtaagaaaaaggcacagcaagcagcagctgacacaggaaacaacagccaggtcagccaaaattaccctatagtgcagaacctccaggggcaaatggtacatcaggccatatcacctagaactttaaatgcatgggtaaaagtagtagaagagaaggctttcagcccagaagtaatacccatgttttcagcattatcagaaggagccaccccacaagatttaaataccatgctaaacacagtggggggacatcaagcagccatgcaaatgttaaaagagaccatcaatgaggaagctgcagaatgggatagattgcatccagtgcatgcagggcctattgcaccaggccagatgagagaaccaagaccgtccatgaagggttcgatggggggcggcgattacttgttatggcaacggcagattcgttaaaggaagctctattagatacaggagcagatgatacagtattagaagaaatgaatttgccaggaagatggaaaccaaaaatgatagggggaattggaggttttatcaaagtaagacagtatgatcagatactcatagaaatctgcggacataaagctataggtacagtattagtaggacctacacctgtcaacataattggaagaaatctgttgactcagattggctgcactttaaattttcccattagtcctattgagactgtaccagtaaaattaaagccaggaatggatggcccaaaagttaaacaatggccattgacagaagaaaaaataaaagcattagtagaaatttgtacagaaatggaaaaggaaggaaaaatttcaaaaattgggcctgaaaatccatacaatactccagtatttgccataaagaaaaaagacagtactaaatggagaaaattagtagatttcagagaacttaataagagaactcaagatttctgggaagttcaattaggaataccacatcctgcagggttaaaacagaaaaaatcagtaacagtactggatgtgggcgatgcatatttttcagttcccttagataaagacttcaggaagtatactgcatttaccatacctagtataaacaatgagacaccagggattagatatcagtacaatgtgcttccacagggatggaaaggatcaccagcaatattccagtgtagcatgacaaaaatcttagagccttttagaaaacaaaatccagacatagtcatctatcaatacatggatgatttgtatgtaggatctgacttagaaatagggcagcatagaacaaaaatagaggaactgagacaacatctgttgaggtggggatttaccacaccagacaaaaaacatcagaaagaacctccattcctttggatgggttatgaactccatcctgataaatggacagtacagcctatagtgctgccagaaaaggacagctggactgtcaatgacatacagaaattagtgggaaaattgaattgggcaagtcagatttatgcagggattaaagtaaggcaattatgtaaacttcttaggggaaccaaagcactaacagaagtagtaccactaacagaagaagcagagctagaactggcagaaaacagggagattctaaaagaaccggtacatggagtgtattatgacccatcaaaagacttaatagcagaaatacagaagcaggggcaaggccaatggacatatcaaatttatcaagagccatttaaaaatctgaaaacaggaaagtatgcaagaatgaagggtgcccacactaatgatgtgaaacaattaacagaggcagtacaaaaaatagccacagaaagcatagtaatatggggaaagactcctaaatttaaattacccatacaaaaggaaacatgggaagcatggtggacagagtattggcaagccacctggattcctgagtgggagtttgtcaatacccctcccttagtgaagttatggtaccagttagagaaagaacccataataggagcagaaactttctatgtagatggggcagccaatagggaaactaaattaggaaaagcaggatatgtaactgacagaggaagacaaaaagttgtccccctaacggacacaacaaatcagaagactgagttacaagcaattcatctagctttgcaggattcgggattagaagtaaacatagtgacagactcacaatatgcattgggaatcattcaagcacaaccagataagagtgaatcagagttagtcagtcaaataatagagcagttaataaaaaaggaaaaagtctacctggcatgggtaccagcacacaaaggaattggaggaaatgaacaagtagataaattggtcagtgctggaatcaggaaagtactatttttagatggaatagataaggcccaagaagaacatgagaaatatcacagtaattggagagcaatggctagtgattttaacctaccacctgtagtagcaaaagaaatagtagccagctgtgataaatgtcagctaaaaggggaagccatgcatggacaagtagactgtagcccaggaatatggcagctagattgtacacatttagaaggaaaagttatcttggtagcagttcatgtagccagtggatatatagaagcagaagtaattccagcagagacagggcaagaaacagcatacttcctcttaaaattagcaggaagatggccagtaaaaacagtacatacagacaatggcagcaatttcaccagtactacagttaaggccgcctgttggtgggcggggatcaagcaggaatttggcattccctacaatccccaaagtcaaggagtaatagaatctatgaataaagaattaaagaaaattataggacaggtaagagatcaggctgaacatcttaagacagcagtacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggaaaggaccagcaaagctcctctggaaaggtgaaggggcagtagtaatacaagataatagtgacataaaagtagtgccaagaagaaaagcaaagatcatcagggattaaccgtccatgaagggttcgattatctgtagccaacattcgatatggcaacggcagattcgttggagatgggggtggaaatggggcaccatgctccttgggatattgatgatctgtagtgctacagaaaaattgtgggtcacagtctattatggggtacctgtgtggaaggaagcaaccaccactctattttgtgcatcagatgctaaagcatatgatacagaggtacataatgtttgggccacacatgcctgtgtacccacagaccccaacccacaagaagtagtattggtaaatgtgacagaaaattttaacatgtggaaaaatgacatggtagaacagatgcatgaggatataatcagtttatgggatcaaagcctaaagccatgtgtaaaattaaccccactctgtgttagtttaaagtgcactgatttgaagaatgatactaataccaatagtagtagcgggagaatgataatggagaaaggagagataaaaaactgctctttcaatatcagcacaagcataagagataaggtgcagaaagaatatgcattcttttataaacttgatatagtaccaatagataataccagctataggttgataagttgtaacacctcagtcattacacaggcctgtccaaaggtatcctttgagccaattcccatacattattgtgccccggctggttttgcgattctaaaatgtaataataagacgttcaatggaacaggaccatgtacaaatgtcagcacagtacaatgtacacatggaatcaggccagtagtatcaactcaactgctgttaaatggcagtctagcagaagaagatgtagtaattagatctgccaatttcacagacaatgctaaaaccataatagtacagctgaacacatctgtagaaattaattgtacaagacccaacaacaatacaagaaaaagtatccgtatccagaggggaccagggagagcatttgttacaataggaaaaataggaaatatgagacaagcacattgtaacattagtagagcaaaatggaatgccactttaaaacagatagctagcaaattaagagaacaatttggaaataataaaacaataatctttaagcaatcctcaggaggggacccagaaattgtaacgcacagttttaattgtggaggggaatttttctactgtaattcaacacaactgtttaatagtacttggtttaatagtacttggagtactgaagggtcaaataacactgaaggaagtgacacaatcacactcccatgcagaataaaacaatttataaacatgtggcaggaagtaggaaaagcaatgtatgcccctcccatcagtggacaaattagatgttcatcaaatattactgggctgctattaacaagagatggtggtaataacaacaatgggtccgagatcttcagacctggaggaggcgatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctgatatagtgcagcagcagaacaatttgctgagggctattgaggcgcaacagcatctgttgcaactcacagtctggggcatcaaacagctccaggcaagaatcctggctgtggaaagatacctaaaggatcaacagctcctggggatttggggttgctctggaaaactcatttgcaccactgctgtgccttggaatgctagttggagtaataaatctctggaacagatttggaataacatgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaatcccgaggggacccgacaggcccgaaggaatagaagaagaaggtggagagagagacagagacagatccattcgattagtgaacggatccttagcacttatctgggacgatctgcggagcctgtgcctcttcagctaccaccgcttgagagacttactcttgattgtaacgaggattgtggaacttctgggacgcagggggtgggaagccctcaaatattggtggaatctcctacagtattggagtcaggaactaaagaatagtgctgttaacttgctcaatgccacagccatagcagtagctgaggggacagatagggttatagaagtattacaagcagcttatagagctattcgccacatacctagaagaataagacagggcttggaaaggattttgctataagatgggtggcaagtggtcaaaaagtagtgtgattggatggcctgctgtaagggaaagaatgagacgagctgagccagcagcagatggggtgggagcagtatctcgagacctagaaaaacatggagcaatcacaagtagcaatacagcagctaacaatgctgcttgtgcctggctagaagcacaagaggaggaagaggtgggttttccagtcacacctcaggtacctttaagaccaatgacttacaaggcagctgtagatcttagccactttttaaaagaaaaggggggactggaagggctaattcactcccaaagaagacaagatatccttgatctgtggatctaccacacacaaggctacttccctgattggcagaactacacaccagggccaggggtcagatatccactgacctttggatggtgctacaagctagtaccagttgagccagataaggtagaagaggccaataaaggagagaacaccagcttgttacaccctgtgagcctgcatggaatggatgaccctgagagagaagtgttagagtggaggtttgacagccgcctagcatttcatcacgtggcccgagagctgcatccggagtacttcaagaactgctgacatcgagcttgctacaagggactttccgctggggactttccagggaggcgtggcctgggcgggactggggagtggcgagccctcagatgctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagca

SEQ ID NO: 103 - DNA, 8023 bp, Artificial Sequence
  Synthetic Sequence
tggaagggctaatttggtcccaaaaaagacaagagatccttgatctgtggatctaccacacacaaggctacttccctgattggcagaactacacaccagggccagggatcagatatccactgacctttggatggtgcttcaagttagtaccagttgaaccagagcaagtagaagaggccaatgaaggagagaacaacagcttgttacaccctatgagccagcatgggatggaggacccggagggagaagtattagtgtggaagtttgacagcctcctagcatttcgtcacatggcccgagagctgcatccggagtactacaaagactgctgacatcgagctttctacaagggactttccgctggggactttccagggaggtgtggcctgggcgggactggggagtggcgagccctcagatgctacatataagcagctgctttttgcctgtactgggtctctctggttagaccagatctgagcctgggagctctctggctaactagggaacccactgcttaagcctcaataaagcttgccttgagtgctcaaagtagtgtgtgcccgtctgttgtgtgactctggtaactagagatccctcagacccttttagtcagtgtggaaaatctctagcagtggcgcccgaacagggacttgaaagcgaaagtaaagccagaggagatctctcgacgcaggactcggcttgctgaagcgcgcacggcaagaggcgaggggcggcgactggtgagtacgccaaaaattttgactagcggaggctagaaggagagagatgggtgcgagagcgtcggtattaagcgggggagaattagataaatgggaaaaaattcggttaaggccagggggaaagaaacaatataaactaaaacatatagtatgggcaagcagggagctagaacgattcgcagttaatcctggccttttagagacatcagaaggctgtagacaaatactgggacagctacaaccatcccttcagacaggatcagaagaacttagatcattatataatacaatagcagtcctctattgtgtgcatcaaaggatagatgtaaaagacaccaaggaagccttagataagatagaggaagagcaaaacaaaagtaagaaaaaggcacagcaagcagcagctgacacaggaaacaacagccaggtcagccaaaattaccctatagtgcagaacctccaggggcaaatggtacatcaggccatatcacctagaactttaaatgcatgggtaaaagtagtagaagagaaggctttcagcccagaagtaatacccatgttttcagcattatcagaaggagccaccccacaagatttaaataccatgctaaacacagtggggggacatcaagcagccatgcaaatgttaaaagagaccatcaatgaggaagctgcagaatgggatagattgcatccagtgcatgcagggcctattgcaccaggccagatgagagaaccaagaccgtccatgaagggttcgatggggggcggcgattacttgttatggcaacggcagattcgttaaaggaagctctattagatacaggagcagatgatacagtattagaagaaatgaatttgccaggaagatggaaaccaaaaatgatagggggaattggaggttttatcaaagtaagacagtatgatcagatactcatagaaatctgcggacataaagctataggtacagtattagtaggacctacacctgtcaacataattggaagaaatctgttgactcagattggctgcactttaaattttcccattagtcctattgagactgtaccagtaaaattaaagccaggaatggatggcccaaaagttaaacaatggccattgacagaagaaaaaataaaagcattagtagaaatttgtacagaaatggaaaaggaaggaaaaatttcaaaaattgggcctgaaaatccatacaatactccagtatttgccataaagaaaaaagacagtactaaatggagaaaattagtagatttcagagaacttaataagagaactcaagatttctgggaagttcaattaggaataccacatcctgcagggttaaaacagaaaaaatcagtaacagtactggatgtgggcgatgcatatttttcagttcccttagataaagacttcaggaagtatactgcatttaccatacctagtataaacaatgagacaccagggattagatatcagtacaatgtgcttccacagggatggaaaggatcaccagcaatattccagtgtagcatgacaaaaatcttagagccttttagaaaacaaaatccagacatagtcatctatcaatacatggatgatttgtatgtaggatctgacttagaaatagggcagcatagaacaaaaatagaggaactgagacaacatctgttgaggtggggatttaccacaccagacaaaaaacatcagaaagaacctccattcctttggatgggttatgaactccatcctgataaatggacagtacagcctatagtgctgccagaaaaggacagctggactgtcaatgacatacagaaattagtgggaaaattgaattgggcaagtcagatttatgcagggattaaagtaaggcaattatgtaaacttcttaggggaaccaaagcactaacagaagtagtaccactaacagaagaagcagagctagaactggcagaaaacagggagattctaaaagaaccggtacatggagtgtattatgacccatcaaaagacttaatagcagaaatacagaagcaggggcaaggccaatggacatatcaaatttatcaagagccatttaaaaatctgaaaacaggaaagtatgcaagaatgaacgaatctgccgttgccatatacagcatctgaacaagctgatcgaacccttcatggacggttaaggccgcctgttggtgggcggggatcaagcaggaatttggcattccctacaatccccaaagtcaaggagtaatagaatctatgaataaagaattaaagaaaattataggacaggtaagagatcaggctgaacatcttaagacagcagtacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggaaaggaccagcaaagctcctctggaaaggtgaaggggcagtagtaatacaagataatagtgacataaaagtagtgccaagaagaaaagcaaagatcatcagggattatggaaaacagatggcaggtgatgattgtgtggcaagtagacaggatgaggattaacacatggaaaagattagtaaaacaccatatgtatatttcaaggaaagctaaggactggttttatagacatcactatgaaagtactaatccaaaaataagttcagaagtacacatcccactaggggatgctaaattagtaataacaacatattggggtctgcatacaggagaaagagactggcatttgggtcagggagtctccatagaatggaggaaaaagagatatagcacacaagtagaccctgacctagcagaccaactaattcatctgcactattttgattgtttttcagaatctgctataagaaataccatattaggacgtatagttagtcctaggtgtgaatatcaagcaggacataacaaggtaggatctctacagtacttggcactagcagcattaataaaaccaaaacagataaagccacctttgcctagtgttaggaaactgacagaggacagatggaacaagccccagaagaccaagggccacagagggagccatacaatgaatggacactagagcttttagaggaacttaagagtgaagctgttagacattttcctaggatatggctccataacttaggacaacatatctatgaaacttacggggatacttgggcaggagtggaagccataataagaattctgcaacaactgctgtttatccatttcagaattgggtgtcgacatagcagaataggcgttactcgacagaggagagcaagaaatggagccagtagatcctagactagagccctggaagcatccaggaagtcagcctaaaactgcttgtaccaattgctattgtaaaaagtgttgctttcattgccaagtttgtttcatgacaaaagccttaggcatctcctatggcaggaagaagcggagacagcgacgaagagctcatcagaacagtcagactcatcaagcttctctatcaaagcagtaagtagtacatgtaatgcaacctataatagtagcaatagtagcattagtagtagcaataataatagcaatagttgtgtggtccatagtaatcatagaatataggaaaatattaagacaaagaaaaatagacaggttaattgatagactaatagaaagagcagaagacagtggcaatgagagtgaaggagaagtatcagcacttgtggagatgggggtggaaatggggcaccatgctccttgggatattgatgatctgtagtgctacagaaaaattgtgggtcacagtctattatggggtacctgtgtggaaggaagcaaccaccactctattttgtgcatcagatgctaaagcatatgatacagaggtacataatgtttgggccacacatgcctgtgtacccacagaccccaacccacaagaagtagtattggtaaatgtgacagaaaattttaacatgtggaaaaatgacatggtagaacagatgcatgaggatataatcagtttatgggatcaaagcctaaagccatgtgtaaaattaaccccactctgtgttagtttaaagtgcactgatttgaagaatgatactaataccaatagtagtagcgggagaatgataatggagaaaggagagataaaaaactgctctttcaatatcagcacaagcataagagataaggtgcagaaagaatatgcattcttttataaacttgatatagtaccaatagataataccagctataggttgataagttgtaacacctcagtcattacacaggcctgtccaaaggtatcctttgagccaattcccatacattattgtgccccggctggttttgcgattctaaaatgtaataataagacgttcaatggaacaggaccatgtacaaatgtcagcacagtacaatgtacacatggaatcaggccagtagtatcaactcaactgctgttaaatggcagtctagcagaagaagatgtagtaattagatctgccaatttcacagacaatgctaaaaccataatagtacagctgaacacatctgtagaaattaattgtacaagacccaacaacaatacaagaaaaagtatccgtatccagaggggaccagggagagcatttgttacaataggaaaaataggaaatatgagacaagcacattgtaacattagtagagcaaaatggaatgccactttaaaacagatagctagcaaattaagagaacaatttggaaataataaaacaataatctttaagcaatcctcaggaggggacccagaaattgtaacgcacagttttaattgtggaggggaatttttctactgtaattcaacacaactgtttaatagtacttggtttaatagtacttggagtactgaagggtcaaataacactgaaggaagtgacacaatcacactcccatgcagaataaaacaatttataaacatgtggcaggaagtaggaaaagcaatgtatgcccctcccatcagtggacaaattagatgttcatcaaatattactgggctgctattaacaagagatggtggtaataacaacaatgggtccgagatcttcagacctggaggaggcgatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctgatatagtgcagcagcagaacaatttgctgagggctattgaggcgcaacagcatctgttgcaactcacagtctggggcatcaaacagctccaggcaagaatcctggctgtggaaagatacctaaaggatcaacagctcctggggatttggggttgctctggaaaactcatttgcaccactgctgtgccttggaatgctagttggagtaataaatctctggaacagatttggaataacatgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaatcccgaggggacccgacaggcccgaaggaatagaagaagaaggtggagagagagacagagacagatccattcgattagtgaacggatccttagcacttatctgggacgatctgcggagcctgtgcctcttcagctaccaccgcttgagagacttactcttgattgtaacgaggattgtggaacttctgggacgcagggggtgggaagccctcaaatattggtggaatctcctacagtattggagtcaggaactaaagaatagtgctgttaacttgctcaatgccacagccatagcagtagctgaggggacagatagggttatagaagtattacaagcagcttatagagctattcgccacatacctagaagaataagacagggcttggaaaggattttgctataagatgggtggcaagtggtcaaaaagtagtgtgattggatggcctgctgtaagggaaagaatgagacgagctgagccagcagcagatggggtgggagcagtatctcgagacctagaaaaacatggagcaatcacaagtagcaatacagcagctaacaatgctgcttgtgcctggctagaagcacaagaggaggaagaggtgggttttccagtcacacctcaggtacctttaagaccaatgacttacaaggcagctgtagatcttagccactttttaaaagaaaaggggggactggaagggctaattcactcccaaagaagacaagatatccttgatctgtggatctaccacacacaaggctacttccctgattggcagaactacacaccagggccaggggtcagatatccactgacctttggatggtgctacaagctagtaccagttgagccagataaggtagaagaggccaataaaggagagaacaccagcttgttacaccctgtgagcctgcatggaatggatgaccctgagagagaagtgttagagtggaggtttgacagccgcctagcatttcatcacgtggcccgagagctgcatccggagtacttcaagaactgctgacatcgagcttgctacaagggactttccgctggggactttccagggaggcgtggcctgggcgggactggggagtggcgagccctcagatgctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagca

SEQ ID NO: 104 - DNA, 7100 bp, Artificial Sequence
  Synthetic Sequence
tggaagggctaatttggtcccaaaaaagacaagagatccttgatctgtggatctaccacacacaaggctacttccctgattggcagaactacacaccagggccagggatcagatatccactgacctttggatggtgcttcaagttagtaccagttgaaccagagcaagtagaagaggccaatgaaggagagaacaacagcttgttacaccctatgagccagcatgggatggaggacccggagggagaagtattagtgtggaagtttgacagcctcctagcatttcgtcacatggcccgagagctgcatccggagtactacaaagactgctgacatcgagctttctacaagggactttccgctggggactttccagggaggtgtggcctgggcgggactggggagtggcgagccctcagatgctacatataagcagctgctttttgcctgtactgggtctctctggttagaccagatctgagcctgggagctctctggctaactagggaacccactgcttaagcctcaataaagcttgccttgagtgctcaaagtagtgtgtgcccgtctgttgtgtgactctggtaactagagatccctcagacccttttagtcagtgtggaaaatctctagcagtggcgcccgaacagggacttgaaagcgaaagtaaagccagaggagatctctcgacgcaggactcggcttgctgaagcgcgcacggcaagaggcgaggggcggcgactggtgagtacgccaaaaattttgactagcggaggctagaaggagagagatgggtgcgagagcgtcggtattaagcgggggagaattagataaatgggaaaaaattcggttaaggccagggggaaagaaacaatataaactaaaacatatagtatgggcaagcagggagctagaacgattcgcagttaatcctggccttttagagacatcagaaggctgtagacaaatactgggacagctacaaccatcccttcagacaggatcagaagaacttagatcattatataatacaatagcagtcctctattgtgtgcatcaaaggatagatgtaaaagacaccaaggaagccttagataagatagaggaagagcaaaacaaaagtaagaaaaaggcacagcaagcagcagctgacacaggaaacaacagccaggtcagccaaaattaccctatagtgcagaacctccaggggcaaatggtacatcaggccatatcacctagaactttaaatgcatgggtaaaagtagtagaagagaaggctttcagcccagaagtaatacccatgttttcagcattatcagaaggagccaccccacaagatttaaataccatgctaaacacagtggggggacatcaagcagccatgcaaatgttaaaagagaccatcaatgaggaagctgcagaatgggatagattgcatccagtgcatgcagggcctattgcaccaggccagatgagagaaccaagaccgtccatgaagggttcgatggggggcggcgattacttgttatggcaacggcagattcgttaaaggaagctctattagatacaggagcagatgatacagtattagaagaaatgaatttgccaggaagatggaaaccaaaaatgatagggggaattggaggttttatcaaagtaagacagtatgatcagatactcatagaaatctgcggacataaagctataggtacagtattagtaggacctacacctgtcaacataattggaagaaatctgttgactcagattggctgcactttaaattttcccattagtcctattgagactgtaccagtaaaattaaagccaggaatggatggcccaaaagttaaacaatggccattgacagaagaaaaaataaaagcattagtagaaatttgtacagaaatggaaaaggaaggaaaaatttcaaaaattgggcctgaaaatccatacaatactccagtatttgccataaagaaaaaagacagtactaaatggagaaaattagtagatttcagagaacttaataagagaactcaagatttctgggaagttcaattaggaataccacatcctgcagggttaaaacagaaaaaatcagtaacagtactggatgtgggcgatgcatatttttcagttcccttagataaagacttcaggaagtatactgcatttaccatacctagtataaacaatgagacaccagggattagatatcagtacaatgtgcttccacagggatggaaaggatcaccagcaatattccagtgtagcatgacaaaaatcttagagccttttagaaaacaaaatccagacatagtcatctatcaatacatggatgatttgtatgtaggatctgacttagaaatagggcagcatagaacaaaaatagaggaactgagacaacatctgttgaggtggggatttaccacaccagacaaaaaacatcagaaagaacctccattcctttggatgggttatgaactccatcctgataaatggacagtacagcctatagtgctgccagaaaaggacagctggactgtcaatgacatacagaaattagtgggaaaattgaattgggcaagtcagatttatgcagggattaaagtaaggcaattatgtaaacttcttaggggaaccaaagcactaacagaagtagtaccactaacagaagaagcagagctagaactggcagaaaacagggagattctaaaagaaccggtacatggagtgtattatgacccatcaaaagacttaatagcagaaatacagaagcaggggcaaggccaatggacatatcaaatttatcaagagccatttaaaaatctgaaaacaggaaagtatgcaagaatgaacgaatctgccgttgccatatacagcatctgaacaagctgatcgaacccttcatggacggttaaggccgcctgttggtgggcggggatcaagcaggaatttggcattccctacaatccccaaagtcaaggagtaatagaatctatgaataaagaattaaagaaaattataggacaggtaagagatcaggctgaacatcttaagacagcagtacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggaaaggaccagcaaagctcctctggaaaggtgaaggggcagtagtaatacaagataatagtgacataaaagtagtgccaagaagaaaagcaaagatcatcagggattatggaaaacagatggcaggtgatgattgtgtggcccgtccatgaagggttcgattcttgaacagcgcggtctgttatggcaacggcagattcgtttaatgcaacctataatagtagcaatagtagcattagtagtagcaataataatagcaatagttgtgtggtccatagtaatcatagaatataggaaaatattaagacaaagaaaaatagacaggttaattgatagactaatagaaagagcagaagacagtggcaatgagagtgaaggagaagtatcagcacttgtggagatgggggtggaaatggggcaccatgctccttgggatattgatgatctgtagtgctacagaaaaattgtgggtcacagtctattatggggtacctgtgtggaaggaagcaaccaccactctattttgtgcatcagatgctaaagcatatgatacagaggtacataatgtttgggccacacatgcctgtgtacccacagaccccaacccacaagaagtagtattggtaaatgtgacagaaaattttaacatgtggaaaaatgacatggtagaacagatgcatgaggatataatcagtttatgggatcaaagcctaaagccatgtgtaaaattaaccccactctgtgttagtttaaagtgcactgatttgaagaatgatactaataccaatagtagtagcgggagaatgataatggagaaaggagagataaaaaactgctctttcaatatcagcacaagcataagagataaggtgcagaaagaatatgcattcttttataaacttgatatagtaccaatagataataccagctataggttgataagttgtaacacctcagtcattacacaggcctgtccaaaggtatcctttgagccaattcccatacattattgtgccccggctggttttgcgattctaaaatgtaataataagacgttcaatggaacaggaccatgtacaaatgtcagcacagtacaatgtacacatggaatcaggccagtagtatcaactcaactgctgttaaatggcagtctagcagaagaagatgtagtaattagatctgccaatttcacagacaatgctaaaaccataatagtacagctgaacacatctgtagaaattaattgtacaagacccaacaacaatacaagaaaaagtatccgtatccagaggggaccagggagagcatttgttacaataggaaaaataggaaatatgagacaagcacattgtaacattagtagagcaaaatggaatgccactttaaaacagatagctagcaaattaagagaacaatttggaaataataaaacaataatctttaagcaatcctcaggaggggacccagaaattgtaacgcacagttttaattgtggaggggaatttttctactgtaattcaacacaactgtttaatagtacttggtttaatagtacttggagtactgaagggtcaaataacactgaaggaagtgacacaatcacactcccatgcagaataaaacaatttataaacatgtggcaggaagtaggaaaagcaatgtatgcccctcccatcagtggacaaattagatgttcatcaaatattactgggctgctattaacaagagatggtggtaataacaacaatgggtccgagatcttcagacctggaggaggcgatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctgatatagtgcagcagcagaacaatttgctgagggctattgaggcgcaacagcatctgttgcaactcacagtctggggcatcaaacagctccaggcaagaatcctggctgtggaaagatacctaaaggatcaacagctcctggggatttggggttgctctggaaaactcatttgcaccactgctgtgccttggaatgctagttggagtaataaatctctggaacagatttggaataacatgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaatcccgaggggacccgacaggcccgaaggaatagaagaagaaggtggagagagagacagagacagatccattcgattagtgaacggatccttagcacttatctgggacgatctgcggagcctgtgcctcttcagctaccaccgcttgagagacttactcttgattgtaacgaggattgtggaacttctgggacgcagggggtgggaagccctcaaatattggtggaatctcctacagtattggagtcaggaactaaagaatagtgctgttaacttgctcaatgccacagccatagcagtagctgaggggacagatagggttatagaagtattacaagcagcttatagagctattcgccacatacctagaagaataagacagggcttggaaaggattttgctataagatgggtggcaagtggtcaaaaagtagtgtgattggatggcctgctgtaagggaaagaatgagacgagctgagccagcagcagatggggtgggagcagtatctcgagacctagaaaaacatggagcaatcacaagtagcaatacagcagctaacaatgctgcttgtgcctggctagaagcacaagaggaggaagaggtgggttttccagtcacacctcaggtacctttaagaccaatgacttacaaggcagctgtagatcttagccactttttaaaagaaaaggggggactggaagggctaattcactcccaaagaagacaagatatccttgatctgtggatctaccacacacaaggctacttccctgattggcagaactacacaccagggccaggggtcagatatccactgacctttggatggtgctacaagctagtaccagttgagccagataaggtagaagaggccaataaaggagagaacaccagcttgttacaccctgtgagcctgcatggaatggatgaccctgagagagaagtgttagagtggaggtttgacagccgcctagcatttcatcacgtggcccgagagctgcatccggagtacttcaagaactgctgacatcgagcttgctacaagggactttccgctggggactttccagggaggcgtggcctgggcgggactggggagtggcgagccctcagatgctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagca

SEQ ID NO: 105 - DNA, 6875 bp, Artificial Sequence
  Synthetic Sequence
tggaagggctaatttggtcccaaaaaagacaagagatccttgatctgtggatctaccacacacaaggctacttccctgattggcagaactacacaccagggccagggatcagatatccactgacctttggatggtgcttcaagttagtaccagttgaaccagagcaagtagaagaggccaatgaaggagagaacaacagcttgttacaccctatgagccagcatgggatggaggacccggagggagaagtattagtgtggaagtttgacagcctcctagcatttcgtcacatggcccgagagctgcatccggagtactacaaagactgctgacatcgagctttctacaagggactttccgctggggactttccagggaggtgtggcctgggcgggactggggagtggcgagccctcagatgctacatataagcagctgctttttgcctgtactgggtctctctggttagaccagatctgagcctgggagctctctggctaactagggaacccactgcttaagcctcaataaagcttgccttgagtgctcaaagtagtgtgtgcccgtctgttgtgtgactctggtaactagagatccctcagacccttttagtcagtgtggaaaatctctagcagtggcgcccgaacagggacttgaaagcgaaagtaaagccagaggagatctctcgacgcaggactcggcttgctgaagcgcgcacggcaagaggcgaggggcggcgactggtgagtacgccaaaaattttgactagcggaggctagaaggagagagatgggtgcgagagcgtcggtattaagcgggggagaattagataaatgggaaaaaattcggttaaggccagggggaaagaaacaatataaactaaaacatatagtatgggcaagcagggagctagaacgattcgcagttaatcctggccttttagagacatcagaaggctgtagacaaatactgggacagctacaaccatcccttcagacaggatcagaagaacttagatcattatataatacaatagcagtcctctattgtgtgcatcaaaggatagatgtaaaagacaccaaggaagccttagataagatagaggaagagcaaaacaaaagtaagaaaaaggcacagcaagcagcagctgacacaggaaacaacagccaggtcagccaaaattaccctatagtgcagaacctccaggggcaaatggtacatcaggccatatcacctagaactttaaatgcatgggtaaaagtagtagaagagaaggctttcagcccagaagtaatacccatgttttcagcattatcagaaggagccaccccacaagatttaaataccatgctaaacacagtggggggacatcaagcagccatgcaaatgttaaaagagaccatcaatgaggaagctgcagaatgggatagattgcatccagtgcatgcagggcctattgcaccaggccagatgagagaaccaagaccgtccatgaagggttcgatggggggcggcgattacttgttatggcaacggcagattcgttaaaggaagctctattagatacaggagcagatgatacagtattagaagaaatgaatttgccaggaagatggaaaccaaaaatgatagggggaattggaggttttatcaaagtaagacagtatgatcagatactcatagaaatctgcggacataaagctataggtacagtattagtaggacctacacctgtcaacataattggaagaaatctgttgactcagattggctgcactttaaattttcccattagtcctattgagactgtaccagtaaaattaaagccaggaatggatggcccaaaagttaaacaatggccattgacagaagaaaaaataaaagcattagtagaaatttgtacagaaatggaaaaggaaggaaaaatttcaaaaattgggcctgaaaatccatacaatactccagtatttgccataaagaaaaaagacagtactaaatggagaaaattagtagatttcagagaacttaataagagaactcaagatttctgggaagttcaattaggaataccacatcctgcagggttaaaacagaaaaaatcagtaacagtactggatgtgggcgatgcatatttttcagttcccttagataaagacttcaggaagtatactgcatttaccatacctagtataaacaatgagacaccagggattagatatcagtacaatgtgcttccacagggatggaaaggatcaccagcaatattccagtgtagcatgacaaaaatcttagagccttttagaaaacaaaatccagacatagtcatctatcaatacatggatgatttgtatgtaggatctgacttagaaatagggcagcatagaacaaaaatagaggaactgagacaacatctgttgaggtggggatttaccacaccagacaaaaaacatcagaaagaacctccattcctttggatgggttatgaactccatcctgataaatggacagtacagcctatagtgctgccagaaaaggacagctggactgtcaatgacatacagaaattagtgggaaaattgaattgggcaagtcagatttatgcagggattaaagtaaggcaattatgtaaacttcttaggggaaccaaagcactaacagaagtagtaccactaacagaagaagcagagctagaactggcagaaaacagggagattctaaaagaaccggtacatggagtgtattatgacccatcaaaagacttaatagcagaaatacagaagcaggggcaaggccaatggacatatcaaatttatcaagagccatttaaaaatctgaaaacaggaaagtatgcaagaatgaacgaatctgccgttgccatatacagcatctgaacaagctgatcgaacccttcatggacggttaaggccgcctgttggtgggcggggatcaagcaggaatttggcattccctacaatccccaaagtcaaggagtaatagaatctatgaataaagaattaaagaaaattataggacaggtaagagatcaggctgaacatcttaagacagcagtacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggaaaggaccagcaaagctcctctggaaaggtgaaggggcagtagtaatacaagataatagtgacataaaagtagtgccaagaagaaaagcaaagatcatcagggattaaccgtccatgaagggttcgattatctgtagccaacattcgatatggcaacggcagattcgttggagatgggggtggaaatggggcaccatgctccttgggatattgatgatctgtagtgctacagaaaaattgtgggtcacagtctattatggggtacctgtgtggaaggaagcaaccaccactctattttgtgcatcagatgctaaagcatatgatacagaggtacataatgtttgggccacacatgcctgtgtacccacagaccccaacccacaagaagtagtattggtaaatgtgacagaaaattttaacatgtggaaaaatgacatggtagaacagatgcatgaggatataatcagtttatgggatcaaagcctaaagccatgtgtaaaattaaccccactctgtgttagtttaaagtgcactgatttgaagaatgatactaataccaatagtagtagcgggagaatgataatggagaaaggagagataaaaaactgctctttcaatatcagcacaagcataagagataaggtgcagaaagaatatgcattcttttataaacttgatatagtaccaatagataataccagctataggttgataagttgtaacacctcagtcattacacaggcctgtccaaaggtatcctttgagccaattcccatacattattgtgccccggctggttttgcgattctaaaatgtaataataagacgttcaatggaacaggaccatgtacaaatgtcagcacagtacaatgtacacatggaatcaggccagtagtatcaactcaactgctgttaaatggcagtctagcagaagaagatgtagtaattagatctgccaatttcacagacaatgctaaaaccataatagtacagctgaacacatctgtagaaattaattgtacaagacccaacaacaatacaagaaaaagtatccgtatccagaggggaccagggagagcatttgttacaataggaaaaataggaaatatgagacaagcacattgtaacattagtagagcaaaatggaatgccactttaaaacagatagctagcaaattaagagaacaatttggaaataataaaacaataatctttaagcaatcctcaggaggggacccagaaattgtaacgcacagttttaattgtggaggggaatttttctactgtaattcaacacaactgtttaatagtacttggtttaatagtacttggagtactgaagggtcaaataacactgaaggaagtgacacaatcacactcccatgcagaataaaacaatttataaacatgtggcaggaagtaggaaaagcaatgtatgcccctcccatcagtggacaaattagatgttcatcaaatattactgggctgctattaacaagagatggtggtaataacaacaatgggtccgagatcttcagacctggaggaggcgatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctgatatagtgcagcagcagaacaatttgctgagggctattgaggcgcaacagcatctgttgcaactcacagtctggggcatcaaacagctccaggcaagaatcctggctgtggaaagatacctaaaggatcaacagctcctggggatttggggttgctctggaaaactcatttgcaccactgctgtgccttggaatgctagttggagtaataaatctctggaacagatttggaataacatgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaatcccgaggggacccgacaggcccgaaggaatagaagaagaaggtggagagagagacagagacagatccattcgattagtgaacggatccttagcacttatctgggacgatctgcggagcctgtgcctcttcagctaccaccgcttgagagacttactcttgattgtaacgaggattgtggaacttctgggacgcagggggtgggaagccctcaaatattggtggaatctcctacagtattggagtcaggaactaaagaatagtgctgttaacttgctcaatgccacagccatagcagtagctgaggggacagatagggttatagaagtattacaagcagcttatagagctattcgccacatacctagaagaataagacagggcttggaaaggattttgctataagatgggtggcaagtggtcaaaaagtagtgtgattggatggcctgctgtaagggaaagaatgagacgagctgagccagcagcagatggggtgggagcagtatctcgagacctagaaaaacatggagcaatcacaagtagcaatacagcagctaacaatgctgcttgtgcctggctagaagcacaagaggaggaagaggtgggttttccagtcacacctcaggtacctttaagaccaatgacttacaaggcagctgtagatcttagccactttttaaaagaaaaggggggactggaagggctaattcactcccaaagaagacaagatatccttgatctgtggatctaccacacacaaggctacttccctgattggcagaactacacaccagggccaggggtcagatatccactgacctttggatggtgctacaagctagtaccagttgagccagataaggtagaagaggccaataaaggagagaacaccagcttgttacaccctgtgagcctgcatggaatggatgaccctgagagagaagtgttagagtggaggtttgacagccgcctagcatttcatcacgtggcccgagagctgcatccggagtacttcaagaactgctgacatcgagcttgctacaagggactttccgctggggactttccagggaggcgtggcctgggcgggactggggagtggcgagccctcagatgctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagca

SEQ ID NO: 106 - DNA, 7989 bp, Artificial Sequence
  Synthetic Sequence
tggaagggctaatttggtcccaaaaaagacaagagatccttgatctgtggatctaccacacacaaggctacttccctgattggcagaactacacaccagggccagggatcagatatccactgacctttggatggtgcttcaagttagtaccagttgaaccagagcaagtagaagaggccaatgaaggagagaacaacagcttgttacaccctatgagccagcatgggatggaggacccggagggagaagtattagtgtggaagtttgacagcctcctagcatttcgtcacatggcccgagagctgcatccggagtactacaaagactgctgacatcgagctttctacaagggactttccgctggggactttccagggaggtgtggcctgggcgggactggggagtggcgagccctcagatgctacatataagcagctgctttttgcctgtactgggtctctctggttagaccagatctgagcctgggagctctctggctaactagggaacccactgcttaagcctcaataaagcttgccttgagtgctcaaagtagtgtgtgcccgtctgttgtgtgactctggtaactagagatccctcagacccttttagtcagtgtggaaaatctctagcagtggcgcccgaacagggacttgaaagcgaaagtaaagccagaggagatctctcgacgcaggactcggcttgctgaagcgcgcacggcaagaggcgaggggcggcgactggtgagtacgccaaaaattttgactagcggaggctagaaggagagagatgggtgcgagagcgtcggtattaagcgggggagaattagataaatgggaaaaaattcggttaaggccagggggaaagaaacaatataaactaaaacatatagtatgggcaagcagggagctagaacgattcgcagttaatcctggccttttagagacatcagaaggctgtagacaaatactgggacagctacaaccatcccttcagacaggatcagaagaacttagatcattatataatacaatagcagtcctctattgtgtgcatcaaaggatagatgtaaaagacaccaaggaagccttagataagatagaggaagagcaaaacaaaagtaagaaaaaggcacagcaagcagcagctgacacaggaaacaacagccaggtcagccaaaattaccctatagtgcagaacctccaggggcaaatggtacatcaggccatatcacctagaactttaaatgcatgggtaaaagtagtagaagagaaggctttcagcccagaagtaatacccatgttttcagcattatcagaaggagccaccccacaagatttaaataccatgctaaacacagtggggggacatcaagcagccatgcaaatgttaaaagagaccatcaatgaggaagctgcagaatgggatagattgcatccagtgcatgcagggcctattgcaccaggccaaccgtccatgaagggttcgatgagctgcagggcatgttatatatggcaacggcagattcgttcaggagcagatgatacagtattagaagaaatgaatttgccaggaagatggaaaccaaaaatgatagggggaattggaggttttatcaaagtaagacagtatgatcagatactcatagaaatctgcggacataaagctataggtacagtattagtaggacctacacctgtcaacataattggaagaaatctgttgactcagattggctgcactttaaattttcccattagtcctattgagactgtaccagtaaaattaaagccaggaatggatggcccaaaagttaaacaatggccattgacagaagaaaaaataaaagcattagtagaaatttgtacagaaatggaaaaggaaggaaaaatttcaaaaattgggcctgaaaatccatacaatactccagtatttgccataaagaaaaaagacagtactaaatggagaaaattagtagatttcagagaacttaataagagaactcaagatttctgggaagttcaattaggaataccacatcctgcagggttaaaacagaaaaaatcagtaacagtactggatgtgggcgatgcatatttttcagttcccttagataaagacttcaggaagtatactgcatttaccatacctagtataaacaatgagacaccagggattagatatcagtacaatgtgcttccacagggatggaaaggatcaccagcaatattccagtgtagcatgacaaaaatcttagagccttttagaaaacaaaatccagacatagtcatctatcaatacatggatgatttgtatgtaggatctgacttagaaatagggcagcatagaacaaaaatagaggaactgagacaacatctgttgaggtggggatttaccacaccagacaaaaaacatcagaaagaacctccattcctttggatgggttatgaactccatcctgataaatggacagtacagcctatagtgctgccagaaaaggacagctggactgtcaatgacatacagaaattagtgggaaaattgaattgggcaagtcagatttatgcagggattaaagtaaggcaattatgtaaacttcttaggggaaccaaagcactaacagaagtagtaccactaacagaagaagcagagctagaactggcagaaaacagggagattctaaaagaaccggtacatggagtgtattatgacccatcaaaagacttaatagcagaaatacagaagcaggggcaaggccaatggacatatcaaatttatcaagagccatttaaaaatctgaaaacaggaaagtatgcaagaatgaagggtgcccacactaatgatgtgaaacaattaacagaggcagtacaaaaaatagccacagaaagcatagtaatatggggaaagactcctaaatttaaattacccatacaaaaggaaacatgggaagcatggtggacagagtattggcaagccacctggattcctgagtgggagtttgtcaatacccctcccttagtgaagttatggtaccagttagagaaagaacccataataggagcagaaactttctatgtagatggggcagccaatagggaaactaaattaggaaaagcaggatatgtaactgacagaggaagacaaaaagttgtccccctaacggacacaacaaatcagaagactgagttacaagcaattcatctagctttgcaggattcgggattagaagtaaacatagtgacagactcacaatatgcattgggaatcattcaagcacaaccagataagagtgaatcagagttagtcagtcaaataatagagcagttaataaaaaaggaaaaagtctacctggcatgggtaccagcacacaaaggaattggaggaaatgaacaagtagataaattggtcagtgctggaatcaggaaagtactatttttagatggaatagataaggcccaagaagaacatgagaaatatcacagtaattggagagcaatggctagtgattttaacctaccacctgtagtagcaaaagaaatagtagccagctgtgataaatgtcagctaaaaggggaagccatgcatggacaagtagactgtagcccaggaatatggcagctagattgtacacatttagaaggaaaagttatcttggtagcagttcatgtagccagtggatatatagaagcagaagtaattccagcagagacagggcaagaaacagcatacttcctcttaaaattagcaggaagatggccagtaaaaacagtacatacagacaatggcagcaatttcaccagtactacagttaaggccgcctgttggtgggcggggatcaagcaggaatttggcattccctacaatccccaaagtcaaggagtaatagaatctatgaataaagaattaaagaaaattataggacaggtaagagatcaggctgaacatcttaagacagcagtacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggaaaggaccagcaaagctcctctggaaaggtgaaggggcagtagtaatacaagataatagtgacataaaagtagtgccaagaagaaaagcaaagatcatcagggattatggaaaacagatggcaggtgatgattgtgtggcccgtccatgaagggttcgattcttgaacagcgcggtctgttatggcaacggcagattcgtttaatgcaacctataatagtagcaatagtagcattagtagtagcaataataatagcaatagttgtgtggtccatagtaatcatagaatataggaaaatattaagacaaagaaaaatagacaggttaattgatagactaatagaaagagcagaagacagtggcaatgagagtgaaggagaagtatcagcacttgtggagatgggggtggaaatggggcaccatgctccttgggatattgatgatctgtagtgctacagaaaaattgtgggtcacagtctattatggggtacctgtgtggaaggaagcaaccaccactctattttgtgcatcagatgctaaagcatatgatacagaggtacataatgtttgggccacacatgcctgtgtacccacagaccccaacccacaagaagtagtattggtaaatgtgacagaaaattttaacatgtggaaaaatgacatggtagaacagatgcatgaggatataatcagtttatgggatcaaagcctaaagccatgtgtaaaattaaccccactctgtgttagtttaaagtgcactgatttgaagaatgatactaataccaatagtagtagcgggagaatgataatggagaaaggagagataaaaaactgctctttcaatatcagcacaagcataagagataaggtgcagaaagaatatgcattcttttataaacttgatatagtaccaatagataataccagctataggttgataagttgtaacacctcagtcattacacaggcctgtccaaaggtatcctttgagccaattcccatacattattgtgccccggctggttttgcgattctaaaatgtaataataagacgttcaatggaacaggaccatgtacaaatgtcagcacagtacaatgtacacatggaatcaggccagtagtatcaactcaactgctgttaaatggcagtctagcagaagaagatgtagtaattagatctgccaatttcacagacaatgctaaaaccataatagtacagctgaacacatctgtagaaattaattgtacaagacccaacaacaatacaagaaaaagtatccgtatccagaggggaccagggagagcatttgttacaataggaaaaataggaaatatgagacaagcacattgtaacattagtagagcaaaatggaatgccactttaaaacagatagctagcaaattaagagaacaatttggaaataataaaacaataatctttaagcaatcctcaggaggggacccagaaattgtaacgcacagttttaattgtggaggggaatttttctactgtaattcaacacaactgtttaatagtacttggtttaatagtacttggagtactgaagggtcaaataacactgaaggaagtgacacaatcacactcccatgcagaataaaacaatttataaacatgtggcaggaagtaggaaaagcaatgtatgcccctcccatcagtggacaaattagatgttcatcaaatattactgggctgctattaacaagagatggtggtaataacaacaatgggtccgagatcttcagacctggaggaggcgatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctgatatagtgcagcagcagaacaatttgctgagggctattgaggcgcaacagcatctgttgcaactcacagtctggggcatcaaacagctccaggcaagaatcctggctgtggaaagatacctaaaggatcaacagctcctggggatttggggttgctctggaaaactcatttgcaccactgctgtgccttggaatgctagttggagtaataaatctctggaacagatttggaataacatgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaatcccgaggggacccgacaggcccgaaggaatagaagaagaaggtggagagagagacagagacagatccattcgattagtgaacggatccttagcacttatctgggacgatctgcggagcctgtgcctcttcagctaccaccgcttgagagacttactcttgattgtaacgaggattgtggaacttctgggacgcagggggtgggaagccctcaaatattggtggaatctcctacagtattggagtcaggaactaaagaatagtgctgttaacttgctcaatgccacagccatagcagtagctgaggggacagatagggttatagaagtattacaagcagcttatagagctattcgccacatacctagaagaataagacagggcttggaaaggattttgctataagatgggtggcaagtggtcaaaaagtagtgtgattggatggcctgctgtaagggaaagaatgagacgagctgagccagcagcagatggggtgggagcagtatctcgagacctagaaaaacatggagcaatcacaagtagcaatacagcagctaacaatgctgcttgtgcctggctagaagcacaagaggaggaagaggtgggttttccagtcacacctcaggtacctttaagaccaatgacttacaaggcagctgtagatcttagccactttttaaaagaaaaggggggactggaagggctaattcactcccaaagaagacaagatatccttgatctgtggatctaccacacacaaggctacttccctgattggcagaactacacaccagggccaggggtcagatatccactgacctttggatggtgctacaagctagtaccagttgagccagataaggtagaagaggccaataaaggagagaacaccagcttgttacaccctgtgagcctgcatggaatggatgaccctgagagagaagtgttagagtggaggtttgacagccgcctagcatttcatcacgtggcccgagagctgcatccggagtacttcaagaactgctgacatcgagcttgctacaagggactttccgctggggactttccagggaggcgtggcctgggcgggactggggagtggcgagccctcagatgctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagca

SEQ ID NO: 107 - DNA, 7764 bp, Artificial Sequence
  Synthetic Sequence
tggaagggctaatttggtcccaaaaaagacaagagatccttgatctgtggatctaccacacacaaggctacttccctgattggcagaactacacaccagggccagggatcagatatccactgacctttggatggtgcttcaagttagtaccagttgaaccagagcaagtagaagaggccaatgaaggagagaacaacagcttgttacaccctatgagccagcatgggatggaggacccggagggagaagtattagtgtggaagtttgacagcctcctagcatttcgtcacatggcccgagagctgcatccggagtactacaaagactgctgacatcgagctttctacaagggactttccgctggggactttccagggaggtgtggcctgggcgggactggggagtggcgagccctcagatgctacatataagcagctgctttttgcctgtactgggtctctctggttagaccagatctgagcctgggagctctctggctaactagggaacccactgcttaagcctcaataaagcttgccttgagtgctcaaagtagtgtgtgcccgtctgttgtgtgactctggtaactagagatccctcagacccttttagtcagtgtggaaaatctctagcagtggcgcccgaacagggacttgaaagcgaaagtaaagccagaggagatctctcgacgcaggactcggcttgctgaagcgcgcacggcaagaggcgaggggcggcgactggtgagtacgccaaaaattttgactagcggaggctagaaggagagagatgggtgcgagagcgtcggtattaagcgggggagaattagataaatgggaaaaaattcggttaaggccagggggaaagaaacaatataaactaaaacatatagtatgggcaagcagggagctagaacgattcgcagttaatcctggccttttagagacatcagaaggctgtagacaaatactgggacagctacaaccatcccttcagacaggatcagaagaacttagatcattatataatacaatagcagtcctctattgtgtgcatcaaaggatagatgtaaaagacaccaaggaagccttagataagatagaggaagagcaaaacaaaagtaagaaaaaggcacagcaagcagcagctgacacaggaaacaacagccaggtcagccaaaattaccctatagtgcagaacctccaggggcaaatggtacatcaggccatatcacctagaactttaaatgcatgggtaaaagtagtagaagagaaggctttcagcccagaagtaatacccatgttttcagcattatcagaaggagccaccccacaagatttaaataccatgctaaacacagtggggggacatcaagcagccatgcaaatgttaaaagagaccatcaatgaggaagctgcagaatgggatagattgcatccagtgcatgcagggcctattgcaccaggccaaccgtccatgaagggttcgatgagctgcagggcatgttatatatggcaacggcagattcgttcaggagcagatgatacagtattagaagaaatgaatttgccaggaagatggaaaccaaaaatgatagggggaattggaggttttatcaaagtaagacagtatgatcagatactcatagaaatctgcggacataaagctataggtacagtattagtaggacctacacctgtcaacataattggaagaaatctgttgactcagattggctgcactttaaattttcccattagtcctattgagactgtaccagtaaaattaaagccaggaatggatggcccaaaagttaaacaatggccattgacagaagaaaaaataaaagcattagtagaaatttgtacagaaatggaaaaggaaggaaaaatttcaaaaattgggcctgaaaatccatacaatactccagtatttgccataaagaaaaaagacagtactaaatggagaaaattagtagatttcagagaacttaataagagaactcaagatttctgggaagttcaattaggaataccacatcctgcagggttaaaacagaaaaaatcagtaacagtactggatgtgggcgatgcatatttttcagttcccttagataaagacttcaggaagtatactgcatttaccatacctagtataaacaatgagacaccagggattagatatcagtacaatgtgcttccacagggatggaaaggatcaccagcaatattccagtgtagcatgacaaaaatcttagagccttttagaaaacaaaatccagacatagtcatctatcaatacatggatgatttgtatgtaggatctgacttagaaatagggcagcatagaacaaaaatagaggaactgagacaacatctgttgaggtggggatttaccacaccagacaaaaaacatcagaaagaacctccattcctttggatgggttatgaactccatcctgataaatggacagtacagcctatagtgctgccagaaaaggacagctggactgtcaatgacatacagaaattagtgggaaaattgaattgggcaagtcagatttatgcagggattaaagtaaggcaattatgtaaacttcttaggggaaccaaagcactaacagaagtagtaccactaacagaagaagcagagctagaactggcagaaaacagggagattctaaaagaaccggtacatggagtgtattatgacccatcaaaagacttaatagcagaaatacagaagcaggggcaaggccaatggacatatcaaatttatcaagagccatttaaaaatctgaaaacaggaaagtatgcaagaatgaagggtgcccacactaatgatgtgaaacaattaacagaggcagtacaaaaaatagccacagaaagcatagtaatatggggaaagactcctaaatttaaattacccatacaaaaggaaacatgggaagcatggtggacagagtattggcaagccacctggattcctgagtgggagtttgtcaatacccctcccttagtgaagttatggtaccagttagagaaagaacccataataggagcagaaactttctatgtagatggggcagccaatagggaaactaaattaggaaaagcaggatatgtaactgacagaggaagacaaaaagttgtccccctaacggacacaacaaatcagaagactgagttacaagcaattcatctagctttgcaggattcgggattagaagtaaacatagtgacagactcacaatatgcattgggaatcattcaagcacaaccagataagagtgaatcagagttagtcagtcaaataatagagcagttaataaaaaaggaaaaagtctacctggcatgggtaccagcacacaaaggaattggaggaaatgaacaagtagataaattggtcagtgctggaatcaggaaagtactatttttagatggaatagataaggcccaagaagaacatgagaaatatcacagtaattggagagcaatggctagtgattttaacctaccacctgtagtagcaaaagaaatagtagccagctgtgataaatgtcagctaaaaggggaagccatgcatggacaagtagactgtagcccaggaatatggcagctagattgtacacatttagaaggaaaagttatcttggtagcagttcatgtagccagtggatatatagaagcagaagtaattccagcagagacagggcaagaaacagcatacttcctcttaaaattagcaggaagatggccagtaaaaacagtacatacagacaatggcagcaatttcaccagtactacagttaaggccgcctgttggtgggcggggatcaagcaggaatttggcattccctacaatccccaaagtcaaggagtaatagaatctatgaataaagaattaaagaaaattataggacaggtaagagatcaggctgaacatcttaagacagcagtacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggaaaggaccagcaaagctcctctggaaaggtgaaggggcagtagtaatacaagataatagtgacataaaagtagtgccaagaagaaaagcaaagatcatcagggattaaccgtccatgaagggttcgattatctgtagccaacattcgatatggcaacggcagattcgttggagatgggggtggaaatggggcaccatgctccttgggatattgatgatctgtagtgctacagaaaaattgtgggtcacagtctattatggggtacctgtgtggaaggaagcaaccaccactctattttgtgcatcagatgctaaagcatatgatacagaggtacataatgtttgggccacacatgcctgtgtacccacagaccccaacccacaagaagtagtattggtaaatgtgacagaaaattttaacatgtggaaaaatgacatggtagaacagatgcatgaggatataatcagtttatgggatcaaagcctaaagccatgtgtaaaattaaccccactctgtgttagtttaaagtgcactgatttgaagaatgatactaataccaatagtagtagcgggagaatgataatggagaaaggagagataaaaaactgctctttcaatatcagcacaagcataagagataaggtgcagaaagaatatgcattcttttataaacttgatatagtaccaatagataataccagctataggttgataagttgtaacacctcagtcattacacaggcctgtccaaaggtatcctttgagccaattcccatacattattgtgccccggctggttttgcgattctaaaatgtaataataagacgttcaatggaacaggaccatgtacaaatgtcagcacagtacaatgtacacatggaatcaggccagtagtatcaactcaactgctgttaaatggcagtctagcagaagaagatgtagtaattagatctgccaatttcacagacaatgctaaaaccataatagtacagctgaacacatctgtagaaattaattgtacaagacccaacaacaatacaagaaaaagtatccgtatccagaggggaccagggagagcatttgttacaataggaaaaataggaaatatgagacaagcacattgtaacattagtagagcaaaatggaatgccactttaaaacagatagctagcaaattaagagaacaatttggaaataataaaacaataatctttaagcaatcctcaggaggggacccagaaattgtaacgcacagttttaattgtggaggggaatttttctactgtaattcaacacaactgtttaatagtacttggtttaatagtacttggagtactgaagggtcaaataacactgaaggaagtgacacaatcacactcccatgcagaataaaacaatttataaacatgtggcaggaagtaggaaaagcaatgtatgcccctcccatcagtggacaaattagatgttcatcaaatattactgggctgctattaacaagagatggtggtaataacaacaatgggtccgagatcttcagacctggaggaggcgatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctgatatagtgcagcagcagaacaatttgctgagggctattgaggcgcaacagcatctgttgcaactcacagtctggggcatcaaacagctccaggcaagaatcctggctgtggaaagatacctaaaggatcaacagctcctggggatttggggttgctctggaaaactcatttgcaccactgctgtgccttggaatgctagttggagtaataaatctctggaacagatttggaataacatgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaatcccgaggggacccgacaggcccgaaggaatagaagaagaaggtggagagagagacagagacagatccattcgattagtgaacggatccttagcacttatctgggacgatctgcggagcctgtgcctcttcagctaccaccgcttgagagacttactcttgattgtaacgaggattgtggaacttctgggacgcagggggtgggaagccctcaaatattggtggaatctcctacagtattggagtcaggaactaaagaatagtgctgttaacttgctcaatgccacagccatagcagtagctgaggggacagatagggttatagaagtattacaagcagcttatagagctattcgccacatacctagaagaataagacagggcttggaaaggattttgctataagatgggtggcaagtggtcaaaaagtagtgtgattggatggcctgctgtaagggaaagaatgagacgagctgagccagcagcagatggggtgggagcagtatctcgagacctagaaaaacatggagcaatcacaagtagcaatacagcagctaacaatgctgcttgtgcctggctagaagcacaagaggaggaagaggtgggttttccagtcacacctcaggtacctttaagaccaatgacttacaaggcagctgtagatcttagccactttttaaaagaaaaggggggactggaagggctaattcactcccaaagaagacaagatatccttgatctgtggatctaccacacacaaggctacttccctgattggcagaactacacaccagggccaggggtcagatatccactgacctttggatggtgctacaagctagtaccagttgagccagataaggtagaagaggccaataaaggagagaacaccagcttgttacaccctgtgagcctgcatggaatggatgaccctgagagagaagtgttagagtggaggtttgacagccgcctagcatttcatcacgtggcccgagagctgcatccggagtacttcaagaactgctgacatcgagcttgctacaagggactttccgctggggactttccagggaggcgtggcctgggcgggactggggagtggcgagccctcagatgctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagca

SEQ ID NO: 108 - DNA, 7988 bp, Artificial Sequence
  Synthetic Sequence
tggaagggctaatttggtcccaaaaaagacaagagatccttgatctgtggatctaccacacacaaggctacttccctgattggcagaactacacaccagggccagggatcagatatccactgacctttggatggtgcttcaagttagtaccagttgaaccagagcaagtagaagaggccaatgaaggagagaacaacagcttgttacaccctatgagccagcatgggatggaggacccggagggagaagtattagtgtggaagtttgacagcctcctagcatttcgtcacatggcccgagagctgcatccggagtactacaaagactgctgacatcgagctttctacaagggactttccgctggggactttccagggaggtgtggcctgggcgggactggggagtggcgagccctcagatgctacatataagcagctgctttttgcctgtactgggtctctctggttagaccagatctgagcctgggagctctctggctaactagggaacccactgcttaagcctcaataaagcttgccttgagtgctcaaagtagtgtgtgcccgtctgttgtgtgactctggtaactagagatccctcagacccttttagtcagtgtggaaaatctctagcagtggcgcccgaacagggacttgaaagcgaaagtaaagccagaggagatctctcgacgcaggactcggcttgctgaagcgcgcacggcaagaggcgaggggcggcgactggtgagtacgccaaaaattttgactagcggaggctagaaggagagagatgggtgcgagagcgtcggtattaagcgggggagaattagataaatgggaaaaaattcggttaaggccagggggaaagaaacaatataaactaaaacatatagtatgggcaagcagggagctagaacgattcgcagttaatcctggccttttagagacatcagaaggctgtagacaaatactgggacagctacaaccatcccttcagacaggatcagaagaacttagatcattatataatacaatagcagtcctctattgtgtgcatcaaaggatagatgtaaaagacaccaaggaagccttagataagatagaggaagagcaaaacaaaagtaagaaaaaggcacagcaagcagcagctgacacaggaaacaacagccaggtcagccaaaattaccctatagtgcagaacctccaggggcaaatggtacatcaggccatatcacctagaactttaaatgcatgggtaaaagtagtagaagagaaggctttcagcccagaagtaatacccatgttttcagcattatcagaaggagccaccccacaagatttaaataccatgctaaacacagtggggggacatcaagcagccatgcaaatgttaaaagagaccatcaatgaggaagctgcagaatgggatagattgcatccagtgcatgcagggcctattgcaccaggccaaccgtccatgaagggttcgatgagctgcagggcatgttatatatggcaacggcagattcgttcaggagcagatgatacagtattagaagaaatgaatttgccaggaagatggaaaccaaaaatgatagggggaattggaggttttatcaaagtaagacagtatgatcagatactcatagaaatctgcggacataaagctataggtacagtattagtaggacctacacctgtcaacataattggaagaaatctgttgactcagattggctgcactttaaattttcccattagtcctattgagactgtaccagtaaaattaaagccaggaatggatggcccaaaagttaaacaatggccattgacagaagaaaaaataaaagcattagtagaaatttgtacagaaatggaaaaggaaggaaaaatttcaaaaattgggcctgaaaatccatacaatactccagtatttgccataaagaaaaaagacagtactaaatggagaaaattagtagatttcagagaacttaataagagaactcaagatttctgggaagttcaattaggaataccacatcctgcagggttaaaacagaaaaaatcagtaacagtactggatgtgggcgatgcatatttttcagttcccttagataaagacttcaggaagtatactgcatttaccatacctagtataaacaatgagacaccagggattagatatcagtacaatgtgcttccacagggatggaaaggatcaccagcaatattccagtgtagcatgacaaaaatcttagagccttttagaaaacaaaatccagacatagtcatctatcaatacatggatgatttgtatgtaggatctgacttagaaatagggcagcatagaacaaaaatagaggaactgagacaacatctgttgaggtggggatttaccacaccagacaaaaaacatcagaaagaacctccattcctttggatgggttatgaactccatcctgataaatggacagtacagcctatagtgctgccagaaaaggacagctggactgtcaatgacatacagaaattagtgggaaaattgaattgggcaagtcagatttatgcagggattaaagtaaggcaattatgtaaacttcttaggggaaccaaagcactaacagaagtagtaccactaacagaagaagcagagctagaactggcagaaaacagggagattctaaaagaaccggtacatggagtgtattatgacccatcaaaagacttaatagcagaaatacagaagcaggggcaaggccaatggacatatcaaatttatcaagagccatttaaaaatctgaaaacaggaaagtatgcaagaatgaacgaatctgccgttgccatatacagcatctgaacaagctgatcgaacccttcatggacggttaaggccgcctgttggtgggcggggatcaagcaggaatttggcattccctacaatccccaaagtcaaggagtaatagaatctatgaataaagaattaaagaaaattataggacaggtaagagatcaggctgaacatcttaagacagcagtacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggaaaggaccagcaaagctcctctggaaaggtgaaggggcagtagtaatacaagataatagtgacataaaagtagtgccaagaagaaaagcaaagatcatcagggattatggaaaacagatggcaggtgatgattgtgtggcaagtagacaggatgaggattaacacatggaaaagattagtaaaacaccatatgtatatttcaaggaaagctaaggactggttttatagacatcactatgaaagtactaatccaaaaataagttcagaagtacacatcccactaggggatgctaaattagtaataacaacatattggggtctgcatacaggagaaagagactggcatttgggtcagggagtctccatagaatggaggaaaaagagatatagcacacaagtagaccctgacctagcagaccaactaattcatctgcactattttgattgtttttcagaatctgctataagaaataccatattaggacgtatagttagtcctaggtgtgaatatcaagcaggacataacaaggtaggatctctacagtacttggcactagcagcattaataaaaccaaaacagataaagccacctttgcctagtgttaggaaactgacagaggacagatggaacaagccccagaagaccaagggccacagagggagccatacaatgaatggacactagagcttttagaggaacttaagagtgaagctgttagacattttcctaggatatggctccataacttaggacaacatatctatgaaacttacggggatacttgggcaggagtggaagccataataagaattctgcaacaactgctgtttatccatttcagaattgggtgtcgacatagcagaataggcgttactcgacagaggagagcaagaaatggagccagtagatcctagactagagccctggaagcatccaggaagtcagcctaaaactgcttgtaccaattgctattgtaaaaagtgttgctttcattgccaagtttgtttcatgacaaaagccttaggcatctcctatggcaggaagaagcggagacagcgacgaagagctcatcagaacagtcagactcatcaagcttctctatcaaagcagtaagtagtacatgtaatgcaacctataatagtagcaatagtagcattagtagtagcaataataatagcaatagttgtgtggtccatagtaatcatagaatataggaaaatattaagacaaagaaaaatagacaggttaattgatagactaatagaaagagcagaagacagtggcaatgagagtgaaggagaagtatcagcacttgtggagatgggggtggaaatggggcaccatgctccttgggatattgatgatctgtagtgctacagaaaaattgtgggtcacagtctattatggggtacctgtgtggaaggaagcaaccaccactctattttgtgcatcagatgctaaagcatatgatacagaggtacataatgtttgggccacacatgcctgtgtacccacagaccccaacccacaagaagtagtattggtaaatgtgacagaaaattttaacatgtggaaaaatgacatggtagaacagatgcatgaggatataatcagtttatgggatcaaagcctaaagccatgtgtaaaattaaccccactctgtgttagtttaaagtgcactgatttgaagaatgatactaataccaatagtagtagcgggagaatgataatggagaaaggagagataaaaaactgctctttcaatatcagcacaagcataagagataaggtgcagaaagaatatgcattcttttataaacttgatatagtaccaatagataataccagctataggttgataagttgtaacacctcagtcattacacaggcctgtccaaaggtatcctttgagccaattcccatacattattgtgccccggctggttttgcgattctaaaatgtaataataagacgttcaatggaacaggaccatgtacaaatgtcagcacagtacaatgtacacatggaatcaggccagtagtatcaactcaactgctgttaaatggcagtctagcagaagaagatgtagtaattagatctgccaatttcacagacaatgctaaaaccataatagtacagctgaacacatctgtagaaattaattgtacaagacccaacaacaatacaagaaaaagtatccgtatccagaggggaccagggagagcatttgttacaataggaaaaataggaaatatgagacaagcacattgtaacattagtagagcaaaatggaatgccactttaaaacagatagctagcaaattaagagaacaatttggaaataataaaacaataatctttaagcaatcctcaggaggggacccagaaattgtaacgcacagttttaattgtggaggggaatttttctactgtaattcaacacaactgtttaatagtacttggtttaatagtacttggagtactgaagggtcaaataacactgaaggaagtgacacaatcacactcccatgcagaataaaacaatttataaacatgtggcaggaagtaggaaaagcaatgtatgcccctcccatcagtggacaaattagatgttcatcaaatattactgggctgctattaacaagagatggtggtaataacaacaatgggtccgagatcttcagacctggaggaggcgatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctgatatagtgcagcagcagaacaatttgctgagggctattgaggcgcaacagcatctgttgcaactcacagtctggggcatcaaacagctccaggcaagaatcctggctgtggaaagatacctaaaggatcaacagctcctggggatttggggttgctctggaaaactcatttgcaccactgctgtgccttggaatgctagttggagtaataaatctctggaacagatttggaataacatgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaatcccgaggggacccgacaggcccgaaggaatagaagaagaaggtggagagagagacagagacagatccattcgattagtgaacggatccttagcacttatctgggacgatctgcggagcctgtgcctcttcagctaccaccgcttgagagacttactcttgattgtaacgaggattgtggaacttctgggacgcagggggtgggaagccctcaaatattggtggaatctcctacagtattggagtcaggaactaaagaatagtgctgttaacttgctcaatgccacagccatagcagtagctgaggggacagatagggttatagaagtattacaagcagcttatagagctattcgccacatacctagaagaataagacagggcttggaaaggattttgctataagatgggtggcaagtggtcaaaaagtagtgtgattggatggcctgctgtaagggaaagaatgagacgagctgagccagcagcagatggggtgggagcagtatctcgagacctagaaaaacatggagcaatcacaagtagcaatacagcagctaacaatgctgcttgtgcctggctagaagcacaagaggaggaagaggtgggttttccagtcacacctcaggtacctttaagaccaatgacttacaaggcagctgtagatcttagccactttttaaaagaaaaggggggactggaagggctaattcactcccaaagaagacaagatatccttgatctgtggatctaccacacacaaggctacttccctgattggcagaactacacaccagggccaggggtcagatatccactgacctttggatggtgctacaagctagtaccagttgagccagataaggtagaagaggccaataaaggagagaacaccagcttgttacaccctgtgagcctgcatggaatggatgaccctgagagagaagtgttagagtggaggtttgacagccgcctagcatttcatcacgtggcccgagagctgcatccggagtacttcaagaactgctgacatcgagcttgctacaagggactttccgctggggactttccagggaggcgtggcctgggcgggactggggagtggcgagccctcagatgctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagca

SEQ ID NO: 109 - DNA, 7065 bp, Artificial Sequence
  Synthetic Sequence
tggaagggctaatttggtcccaaaaaagacaagagatccttgatctgtggatctaccacacacaaggctacttccctgattggcagaactacacaccagggccagggatcagatatccactgacctttggatggtgcttcaagttagtaccagttgaaccagagcaagtagaagaggccaatgaaggagagaacaacagcttgttacaccctatgagccagcatgggatggaggacccggagggagaagtattagtgtggaagtttgacagcctcctagcatttcgtcacatggcccgagagctgcatccggagtactacaaagactgctgacatcgagctttctacaagggactttccgctggggactttccagggaggtgtggcctgggcgggactggggagtggcgagccctcagatgctacatataagcagctgctttttgcctgtactgggtctctctggttagaccagatctgagcctgggagctctctggctaactagggaacccactgcttaagcctcaataaagcttgccttgagtgctcaaagtagtgtgtgcccgtctgttgtgtgactctggtaactagagatccctcagacccttttagtcagtgtggaaaatctctagcagtggcgcccgaacagggacttgaaagcgaaagtaaagccagaggagatctctcgacgcaggactcggcttgctgaagcgcgcacggcaagaggcgaggggcggcgactggtgagtacgccaaaaattttgactagcggaggctagaaggagagagatgggtgcgagagcgtcggtattaagcgggggagaattagataaatgggaaaaaattcggttaaggccagggggaaagaaacaatataaactaaaacatatagtatgggcaagcagggagctagaacgattcgcagttaatcctggccttttagagacatcagaaggctgtagacaaatactgggacagctacaaccatcccttcagacaggatcagaagaacttagatcattatataatacaatagcagtcctctattgtgtgcatcaaaggatagatgtaaaagacaccaaggaagccttagataagatagaggaagagcaaaacaaaagtaagaaaaaggcacagcaagcagcagctgacacaggaaacaacagccaggtcagccaaaattaccctatagtgcagaacctccaggggcaaatggtacatcaggccatatcacctagaactttaaatgcatgggtaaaagtagtagaagagaaggctttcagcccagaagtaatacccatgttttcagcattatcagaaggagccaccccacaagatttaaataccatgctaaacacagtggggggacatcaagcagccatgcaaatgttaaaagagaccatcaatgaggaagctgcagaatgggatagattgcatccagtgcatgcagggcctattgcaccaggccaaccgtccatgaagggttcgatgagctgcagggcatgttatatatggcaacggcagattcgttcaggagcagatgatacagtattagaagaaatgaatttgccaggaagatggaaaccaaaaatgatagggggaattggaggttttatcaaagtaagacagtatgatcagatactcatagaaatctgcggacataaagctataggtacagtattagtaggacctacacctgtcaacataattggaagaaatctgttgactcagattggctgcactttaaattttcccattagtcctattgagactgtaccagtaaaattaaagccaggaatggatggcccaaaagttaaacaatggccattgacagaagaaaaaataaaagcattagtagaaatttgtacagaaatggaaaaggaaggaaaaatttcaaaaattgggcctgaaaatccatacaatactccagtatttgccataaagaaaaaagacagtactaaatggagaaaattagtagatttcagagaacttaataagagaactcaagatttctgggaagttcaattaggaataccacatcctgcagggttaaaacagaaaaaatcagtaacagtactggatgtgggcgatgcatatttttcagttcccttagataaagacttcaggaagtatactgcatttaccatacctagtataaacaatgagacaccagggattagatatcagtacaatgtgcttccacagggatggaaaggatcaccagcaatattccagtgtagcatgacaaaaatcttagagccttttagaaaacaaaatccagacatagtcatctatcaatacatggatgatttgtatgtaggatctgacttagaaatagggcagcatagaacaaaaatagaggaactgagacaacatctgttgaggtggggatttaccacaccagacaaaaaacatcagaaagaacctccattcctttggatgggttatgaactccatcctgataaatggacagtacagcctatagtgctgccagaaaaggacagctggactgtcaatgacatacagaaattagtgggaaaattgaattgggcaagtcagatttatgcagggattaaagtaaggcaattatgtaaacttcttaggggaaccaaagcactaacagaagtagtaccactaacagaagaagcagagctagaactggcagaaaacagggagattctaaaagaaccggtacatggagtgtattatgacccatcaaaagacttaatagcagaaatacagaagcaggggcaaggccaatggacatatcaaatttatcaagagccatttaaaaatctgaaaacaggaaagtatgcaagaatgaacgaatctgccgttgccatatacagcatctgaacaagctgatcgaacccttcatggacggttaaggccgcctgttggtgggcggggatcaagcaggaatttggcattccctacaatccccaaagtcaaggagtaatagaatctatgaataaagaattaaagaaaattataggacaggtaagagatcaggctgaacatcttaagacagcagtacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggaaaggaccagcaaagctcctctggaaaggtgaaggggcagtagtaatacaagataatagtgacataaaagtagtgccaagaagaaaagcaaagatcatcagggattatggaaaacagatggcaggtgatgattgtgtggcccgtccatgaagggttcgattcttgaacagcgcggtctgttatggcaacggcagattcgtttaatgcaacctataatagtagcaatagtagcattagtagtagcaataataatagcaatagttgtgtggtccatagtaatcatagaatataggaaaatattaagacaaagaaaaatagacaggttaattgatagactaatagaaagagcagaagacagtggcaatgagagtgaaggagaagtatcagcacttgtggagatgggggtggaaatggggcaccatgctccttgggatattgatgatctgtagtgctacagaaaaattgtgggtcacagtctattatggggtacctgtgtggaaggaagcaaccaccactctattttgtgcatcagatgctaaagcatatgatacagaggtacataatgtttgggccacacatgcctgtgtacccacagaccccaacccacaagaagtagtattggtaaatgtgacagaaaattttaacatgtggaaaaatgacatggtagaacagatgcatgaggatataatcagtttatgggatcaaagcctaaagccatgtgtaaaattaaccccactctgtgttagtttaaagtgcactgatttgaagaatgatactaataccaatagtagtagcgggagaatgataatggagaaaggagagataaaaaactgctctttcaatatcagcacaagcataagagataaggtgcagaaagaatatgcattcttttataaacttgatatagtaccaatagataataccagctataggttgataagttgtaacacctcagtcattacacaggcctgtccaaaggtatcctttgagccaattcccatacattattgtgccccggctggttttgcgattctaaaatgtaataataagacgttcaatggaacaggaccatgtacaaatgtcagcacagtacaatgtacacatggaatcaggccagtagtatcaactcaactgctgttaaatggcagtctagcagaagaagatgtagtaattagatctgccaatttcacagacaatgctaaaaccataatagtacagctgaacacatctgtagaaattaattgtacaagacccaacaacaatacaagaaaaagtatccgtatccagaggggaccagggagagcatttgttacaataggaaaaataggaaatatgagacaagcacattgtaacattagtagagcaaaatggaatgccactttaaaacagatagctagcaaattaagagaacaatttggaaataataaaacaataatctttaagcaatcctcaggaggggacccagaaattgtaacgcacagttttaattgtggaggggaatttttctactgtaattcaacacaactgtttaatagtacttggtttaatagtacttggagtactgaagggtcaaataacactgaaggaagtgacacaatcacactcccatgcagaataaaacaatttataaacatgtggcaggaagtaggaaaagcaatgtatgcccctcccatcagtggacaaattagatgttcatcaaatattactgggctgctattaacaagagatggtggtaataacaacaatgggtccgagatcttcagacctggaggaggcgatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctgatatagtgcagcagcagaacaatttgctgagggctattgaggcgcaacagcatctgttgcaactcacagtctggggcatcaaacagctccaggcaagaatcctggctgtggaaagatacctaaaggatcaacagctcctggggatttggggttgctctggaaaactcatttgcaccactgctgtgccttggaatgctagttggagtaataaatctctggaacagatttggaataacatgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaatcccgaggggacccgacaggcccgaaggaatagaagaagaaggtggagagagagacagagacagatccattcgattagtgaacggatccttagcacttatctgggacgatctgcggagcctgtgcctcttcagctaccaccgcttgagagacttactcttgattgtaacgaggattgtggaacttctgggacgcagggggtgggaagccctcaaatattggtggaatctcctacagtattggagtcaggaactaaagaatagtgctgttaacttgctcaatgccacagccatagcagtagctgaggggacagatagggttatagaagtattacaagcagcttatagagctattcgccacatacctagaagaataagacagggcttggaaaggattttgctataagatgggtggcaagtggtcaaaaagtagtgtgattggatggcctgctgtaagggaaagaatgagacgagctgagccagcagcagatggggtgggagcagtatctcgagacctagaaaaacatggagcaatcacaagtagcaatacagcagctaacaatgctgcttgtgcctggctagaagcacaagaggaggaagaggtgggttttccagtcacacctcaggtacctttaagaccaatgacttacaaggcagctgtagatcttagccactttttaaaagaaaaggggggactggaagggctaattcactcccaaagaagacaagatatccttgatctgtggatctaccacacacaaggctacttccctgattggcagaactacacaccagggccaggggtcagatatccactgacctttggatggtgctacaagctagtaccagttgagccagataaggtagaagaggccaataaaggagagaacaccagcttgttacaccctgtgagcctgcatggaatggatgaccctgagagagaagtgttagagtggaggtttgacagccgcctagcatttcatcacgtggcccgagagctgcatccggagtacttcaagaactgctgacatcgagcttgctacaagggactttccgctggggactttccagggaggcgtggcctgggcgggactggggagtggcgagccctcagatgctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagca

SEQ ID NO: 110 - DNA, 6840 bp, Artificial Sequence
  Synthetic Sequence
tggaagggctaatttggtcccaaaaaagacaagagatccttgatctgtggatctaccacacacaaggctacttccctgattggcagaactacacaccagggccagggatcagatatccactgacctttggatggtgcttcaagttagtaccagttgaaccagagcaagtagaagaggccaatgaaggagagaacaacagcttgttacaccctatgagccagcatgggatggaggacccggagggagaagtattagtgtggaagtttgacagcctcctagcatttcgtcacatggcccgagagctgcatccggagtactacaaagactgctgacatcgagctttctacaagggactttccgctggggactttccagggaggtgtggcctgggcgggactggggagtggcgagccctcagatgctacatataagcagctgctttttgcctgtactgggtctctctggttagaccagatctgagcctgggagctctctggctaactagggaacccactgcttaagcctcaataaagcttgccttgagtgctcaaagtagtgtgtgcccgtctgttgtgtgactctggtaactagagatccctcagacccttttagtcagtgtggaaaatctctagcagtggcgcccgaacagggacttgaaagcgaaagtaaagccagaggagatctctcgacgcaggactcggcttgctgaagcgcgcacggcaagaggcgaggggcggcgactggtgagtacgccaaaaattttgactagcggaggctagaaggagagagatgggtgcgagagcgtcggtattaagcgggggagaattagataaatgggaaaaaattcggttaaggccagggggaaagaaacaatataaactaaaacatatagtatgggcaagcagggagctagaacgattcgcagttaatcctggccttttagagacatcagaaggctgtagacaaatactgggacagctacaaccatcccttcagacaggatcagaagaacttagatcattatataatacaatagcagtcctctattgtgtgcatcaaaggatagatgtaaaagacaccaaggaagccttagataagatagaggaagagcaaaacaaaagtaagaaaaaggcacagcaagcagcagctgacacaggaaacaacagccaggtcagccaaaattaccctatagtgcagaacctccaggggcaaatggtacatcaggccatatcacctagaactttaaatgcatgggtaaaagtagtagaagagaaggctttcagcccagaagtaatacccatgttttcagcattatcagaaggagccaccccacaagatttaaataccatgctaaacacagtggggggacatcaagcagccatgcaaatgttaaaagagaccatcaatgaggaagctgcagaatgggatagattgcatccagtgcatgcagggcctattgcaccaggccaaccgtccatgaagggttcgatgagctgcagggcatgttatatatggcaacggcagattcgttcaggagcagatgatacagtattagaagaaatgaatttgccaggaagatggaaaccaaaaatgatagggggaattggaggttttatcaaagtaagacagtatgatcagatactcatagaaatctgcggacataaagctataggtacagtattagtaggacctacacctgtcaacataattggaagaaatctgttgactcagattggctgcactttaaattttcccattagtcctattgagactgtaccagtaaaattaaagccaggaatggatggcccaaaagttaaacaatggccattgacagaagaaaaaataaaagcattagtagaaatttgtacagaaatggaaaaggaaggaaaaatttcaaaaattgggcctgaaaatccatacaatactccagtatttgccataaagaaaaaagacagtactaaatggagaaaattagtagatttcagagaacttaataagagaactcaagatttctgggaagttcaattaggaataccacatcctgcagggttaaaacagaaaaaatcagtaacagtactggatgtgggcgatgcatatttttcagttcccttagataaagacttcaggaagtatactgcatttaccatacctagtataaacaatgagacaccagggattagatatcagtacaatgtgcttccacagggatggaaaggatcaccagcaatattccagtgtagcatgacaaaaatcttagagccttttagaaaacaaaatccagacatagtcatctatcaatacatggatgatttgtatgtaggatctgacttagaaatagggcagcatagaacaaaaatagaggaactgagacaacatctgttgaggtggggatttaccacaccagacaaaaaacatcagaaagaacctccattcctttggatgggttatgaactccatcctgataaatggacagtacagcctatagtgctgccagaaaaggacagctggactgtcaatgacatacagaaattagtgggaaaattgaattgggcaagtcagatttatgcagggattaaagtaaggcaattatgtaaacttcttaggggaaccaaagcactaacagaagtagtaccactaacagaagaagcagagctagaactggcagaaaacagggagattctaaaagaaccggtacatggagtgtattatgacccatcaaaagacttaatagcagaaatacagaagcaggggcaaggccaatggacatatcaaatttatcaagagccatttaaaaatctgaaaacaggaaagtatgcaagaatgaacgaatctgccgttgccatatacagcatctgaacaagctgatcgaacccttcatggacggttaaggccgcctgttggtgggcggggatcaagcaggaatttggcattccctacaatccccaaagtcaaggagtaatagaatctatgaataaagaattaaagaaaattataggacaggtaagagatcaggctgaacatcttaagacagcagtacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggaaaggaccagcaaagctcctctggaaaggtgaaggggcagtagtaatacaagataatagtgacataaaagtagtgccaagaagaaaagcaaagatcatcagggattaaccgtccatgaagggttcgattatctgtagccaacattcgatatggcaacggcagattcgttggagatgggggtggaaatggggcaccatgctccttgggatattgatgatctgtagtgctacagaaaaattgtgggtcacagtctattatggggtacctgtgtggaaggaagcaaccaccactctattttgtgcatcagatgctaaagcatatgatacagaggtacataatgtttgggccacacatgcctgtgtacccacagaccccaacccacaagaagtagtattggtaaatgtgacagaaaattttaacatgtggaaaaatgacatggtagaacagatgcatgaggatataatcagtttatgggatcaaagcctaaagccatgtgtaaaattaaccccactctgtgttagtttaaagtgcactgatttgaagaatgatactaataccaatagtagtagcgggagaatgataatggagaaaggagagataaaaaactgctctttcaatatcagcacaagcataagagataaggtgcagaaagaatatgcattcttttataaacttgatatagtaccaatagataataccagctataggttgataagttgtaacacctcagtcattacacaggcctgtccaaaggtatcctttgagccaattcccatacattattgtgccccggctggttttgcgattctaaaatgtaataataagacgttcaatggaacaggaccatgtacaaatgtcagcacagtacaatgtacacatggaatcaggccagtagtatcaactcaactgctgttaaatggcagtctagcagaagaagatgtagtaattagatctgccaatttcacagacaatgctaaaaccataatagtacagctgaacacatctgtagaaattaattgtacaagacccaacaacaatacaagaaaaagtatccgtatccagaggggaccagggagagcatttgttacaataggaaaaataggaaatatgagacaagcacattgtaacattagtagagcaaaatggaatgccactttaaaacagatagctagcaaattaagagaacaatttggaaataataaaacaataatctttaagcaatcctcaggaggggacccagaaattgtaacgcacagttttaattgtggaggggaatttttctactgtaattcaacacaactgtttaatagtacttggtttaatagtacttggagtactgaagggtcaaataacactgaaggaagtgacacaatcacactcccatgcagaataaaacaatttataaacatgtggcaggaagtaggaaaagcaatgtatgcccctcccatcagtggacaaattagatgttcatcaaatattactgggctgctattaacaagagatggtggtaataacaacaatgggtccgagatcttcagacctggaggaggcgatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctgatatagtgcagcagcagaacaatttgctgagggctattgaggcgcaacagcatctgttgcaactcacagtctggggcatcaaacagctccaggcaagaatcctggctgtggaaagatacctaaaggatcaacagctcctggggatttggggttgctctggaaaactcatttgcaccactgctgtgccttggaatgctagttggagtaataaatctctggaacagatttggaataacatgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaatcccgaggggacccgacaggcccgaaggaatagaagaagaaggtggagagagagacagagacagatccattcgattagtgaacggatccttagcacttatctgggacgatctgcggagcctgtgcctcttcagctaccaccgcttgagagacttactcttgattgtaacgaggattgtggaacttctgggacgcagggggtgggaagccctcaaatattggtggaatctcctacagtattggagtcaggaactaaagaatagtgctgttaacttgctcaatgccacagccatagcagtagctgaggggacagatagggttatagaagtattacaagcagcttatagagctattcgccacatacctagaagaataagacagggcttggaaaggattttgctataagatgggtggcaagtggtcaaaaagtagtgtgattggatggcctgctgtaagggaaagaatgagacgagctgagccagcagcagatggggtgggagcagtatctcgagacctagaaaaacatggagcaatcacaagtagcaatacagcagctaacaatgctgcttgtgcctggctagaagcacaagaggaggaagaggtgggttttccagtcacacctcaggtacctttaagaccaatgacttacaaggcagctgtagatcttagccactttttaaaagaaaaggggggactggaagggctaattcactcccaaagaagacaagatatccttgatctgtggatctaccacacacaaggctacttccctgattggcagaactacacaccagggccaggggtcagatatccactgacctttggatggtgctacaagctagtaccagttgagccagataaggtagaagaggccaataaaggagagaacaccagcttgttacaccctgtgagcctgcatggaatggatgaccctgagagagaagtgttagagtggaggtttgacagccgcctagcatttcatcacgtggcccgagagctgcatccggagtacttcaagaactgctgacatcgagcttgctacaagggactttccgctggggactttccagggaggcgtggcctgggcgggactggggagtggcgagccctcagatgctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagca

SEQ ID NO: 111 - DNA, 8976 bp, Artificial Sequence
  Synthetic Sequence
tggaagggctaatttggtcccaaaaaagacaagagatccttgatctgtggatctaccacacacaaggctacttccctgattggcagaactacacaccagggccagggatcagatatccactgacctttggatggtgcttcaagttagtaccagttgaaccagagcaagtagaagaggccaatgaaggagagaacaacagcttgttacaccctatgagccagcatgggatggaggacccggagggagaagtattagtgtggaagtttgacagcctcctagcatttcgtcacatggcccgagagctgcatccggagtactacaaagactgctgacatcgagctttctacaagggactttccgctggggactttccagggaggtgtggcctgggcgggactggggagtggcgagccctcagatgctacatataagcagctgctttttgcctgtactgggtctctctggttagaccagatctgagcctgggagctctctggctaactagggaacccactgcttaagcctcaataaagcttgccttgagtgctcaaagtagtgtgtgcccgtctgttgtgtgactctggtaactagagatccctcagacccttttagtcagtgtggaaaatctctagcagtggcgcccgaacagggacttgaaagcgaaagtaaagccagaggagatctctcgacgcaggactcggcttgctgaagcgcgcacggcaagaggcgaggggcggcgactggtgagtacgccaaaaattttgactagcggaggctagaaggagagagatgggtgcgagagcgtcggtattaagcgggggagaattagataaatgggaaaaaattcggttaaggccagggggaaagaaacaatataaactaaaacatatagtatgggcaagcagggagctagaacgattcgcagttaatcctggccttttagagacatcagaaggctgtagacaaatactgggacagctacaaccatcccttcagacaggatcagaagaacttagatcattatataatacaatagcagtcctctattgtgtgcatcaaaggatagatgtaaaagacaccaaggaagccttagataagatagaggaagagcaaaacaaaagtaagaaaaaggcacagcaagcagcagctgacacaggaaacaacagccaggtcagccaaaattaccctatagtgcagaacctccaggggcaaatggtacatcaggccatatcacctagaactttaaatgcatgggtaaaagtagtagaagagaaggctttcagcccagaagtaatacccatgttttcagcattatcagaaggagccaccccacaagatttaaataccatgctaaacacagtggggggacatcaagcagccatgcaaatgttaaaagagaccatcaatgaggaagctgcagaatgggatagattgcatccagtgcatgcagggcctattgcaccaggccagatgagagaaccaaggggaagtgacatagcaggaactactagtacccttcaggaacaaataggatggatgacacataatccacctatcccaaccgtccatgaagggttcgatggcgaccctcggccgtggactatggcaacggcagattcgttaaatgaatttgccaggaagatggaaaccaaaaatgatagggggaattggaggttttatcaaagtaagacagtatgatcagatactcatagaaatctgcggacataaagctataggtacagtattagtaggacctacacctgtcaacataattggaagaaatctgttgactcagattggctgcactttaaattttcccattagtcctattgagactgtaccagtaaaattaaagccaggaatggatggcccaaaagttaaacaatggccattgacagaagaaaaaataaaagcattagtagaaatttgtacagaaatggaaaaggaaggaaaaatttcaaaaattgggcctgaaaatccatacaatactccagtatttgccataaagaaaaaagacagtactaaatggagaaaattagtagatttcagagaacttaataagagaactcaagatttctgggaagttcaattaggaataccacatcctgcagggttaaaacagaaaaaatcagtaacagtactggatgtgggcgatgcatatttttcagttcccttagataaagacttcaggaagtatactgcatttaccatacctagtataaacaatgagacaccagggattagatatcagtacaatgtgcttccacagggatggaaaggatcaccagcaatattccagtgtagcatgacaaaaatcttagagccttttagaaaacaaaatccagacatagtcatctatcaatacatggatgatttgtatgtaggatctgacttagaaatagggcagcatagaacaaaaatagaggaactgagacaacatctgttgaggtggggatttaccacaccagacaaaaaacatcagaaagaacctccattcctttggatgggttatgaactccatcctgataaatggacagtacagcctatagtgctgccagaaaaggacagctggactgtcaatgacatacagaaattagtgggaaaattgaattgggcaagtcagatttatgcagggattaaagtaaggcaattatgtaaacttcttaggggaaccaaagcactaacagaagtagtaccactaacagaagaagcagagctagaactggcagaaaacagggagattctaaaagaaccggtacatggagtgtattatgacccatcaaaagacttaatagcagaaatacagaagcaggggcaaggccaatggacatatcaaatttatcaagagccatttaaaaatctgaaaacaggaaagtatgcaagaatgaagggtgcccacactaatgatgtgaaacaattaacagaggcagtacaaaaaatagccacagaaagcatagtaatatggggaaagactcctaaatttaaattacccatacaaaaggaaacatgggaagcatggtggacagagtattggcaagccacctggattcctgagtgggagtttgtcaatacccctcccttagtgaagttatggtaccagttagagaaagaacccataataggagcagaaactttctatgtagatggggcagccaatagggaaactaaattaggaaaagcaggatatgtaactgacagaggaagacaaaaagttgtccccctaacggacacaacaaatcagaagactgagttacaagcaattcatctagctttgcaggattcgggattagaagtaaacatagtgacagactcacaatatgcattgggaatcattcaagcacaaccagataagagtgaatcagagttagtcagtcaaataatagagcagttaataaaaaaggaaaaagtctacctggcatgggtaccagcacacaaaggaattggaggaaatgaacaagtagataaattggtcagtgctggaatcaggaaagtactatttttagatggaatagataaggcccaagaagaacatgagaaatatcacagtaattggagagcaatggctagtgattttaacctaccacctgtagtagcaaaagaaatagtagccagctgtgataaatgtcagctaaaaggggaagccatgcatggacaagtagactgtagcccaggaatatggcagctagattgtacacatttagaaggaaaagttatcttggtagcagttcatgtagccagtggatatatagaagcagaagtaattccagcagagacagggcaagaaacagcatacttcctcttaaaattagcaggaagatggccagtaaaaacagtacatacagacaatggcagcaatttcaccagtactacagttaaggccgcctgttggtgggcggggatcaagcaggaatttggcattccctacaatccccaaagtcaaggagtaatagaatctatgaataaagaattaaagaaaattataggacaggtaagagatcaggctgaacatcttaagacagcagtacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggaaaggaccagcaaagctcctctggaaaggtgaaggggcagtagtaatacaagataatagtgacataaaagtagtgccaagaagaaaagcaaagatcatcagggattatggaaaacagatggcaggtgatgattgtgtggcaagtagacaggatgaggattaacacatggaaaagattagtaaaacaccatatgtatatttcaaggaaagctaaggactggttttatagacatcactatgaaagtactaatccaaaaataagttcagaagtacacatcccactaggggatgctaaattagtaataacaacatattggggtctgcatacaggagaaagagactggcatttgggtcagggagtctccatagaatggaggaaaaagagatatagcacacaagtagaccctgacctagcagaccaactaattcatctgcactattttgattgtttttcagaatctgctataagaaataccatattaggacgtatagttagtcctaggtgtgaatatcaagcaggacataacaaggtaggatctctacagtacttggcactagcagcattaataaaaccaaaacagataaagccacctttgcctagtgttaggaaactgacagaggacagatggaacaagccccagaagaccaagggccacagagggagccatacaatgaatggacactagagcttttagaggaacttaagagtgaagctgttagacattttcctaggatatggctccataacttaggacaacatatctatgaaacttacggggatacttgggcaggagtggaagccataataagaattctgcaacaactgctgtttatccatttcagaattgggtgtcgacatagcagaataggcgttactcgacagaggagagcaagaaatggagccagtagatcctagactagagccctggaagcatccaggaagtcagcctaaaactgcttgtaccaattgctattgtaaaaagtgttgctttcattgccaagtttgtttcatgacaaaagccttaggcatctcctatggcaggaagaagcggagacagcgacgaagagctcatcagaacagtcagactcatcaagcttctctatcaaagcagtaagtagtacatgtaatgcaacctataatagtagcaatagtagcattagtagtagcaataataatagcaatagttgtgtggtccatagtaatcatagaatataggaaaatattaagacaaagaaaaatagacaggttaattgatagactaatagaaagagcagaagacagtggcaatgagagtgaaggagaagtatcagcacttgtggagatgggggtggaaatggggcaccatgctccttgggatattgatgatctgtagtgctacagaaaaattgtgggtcacagtctattatggggtacctgtgtggaaggaagcaaccaccactctattttgtgcatcagatgctaaagcatatgatacagaggtacataatgtttgggccacacatgcctgtgtacccacagaccccaacccacaagaagtagtattggtaaatgtgacagaaaattttaacatgtggaaaaatgacatggtagaacagatgcatgaggatataatcagtttatgggatcaaagcctaaagccatgtgtaaaattaaccccactctgtgttagtttaaagtgcactgatttgaagaatgatactaataccaatagtagtagcgggagaatgataatggagaaaggagagataaaaaactgctctttcaatatcagcacaagcataagagataaggtgcagaaagaatatgcattcttttataaacttgatatagtaccaatagataataccagctataggttgataagttgtaacacctcagtcattacacaggcctgtccaaaggtatcctttgagccaattcccatacattattgtgccccggctggttttgcgattctaaaatgtaataataagacgttcaatggaacaggaccatgtacaaatgtcagcacagtacaatgtacacatggaatcaggccagtagtatcaactcaactgctgttaaatggcagtctagcagaagaagatgtagtaattagatctgccaatttcacagacaatgctaaaaccataatagtacagctgaacacatctgtagaaattaattgtacaagacccaacaacaatacaagaaaaagtatccgtatccagaggggaccagggagagcatttgttacaataggaaaaataggaaatatgagacaagcacattgtaacattagtagagcaaaatggaatgccactttaaaacagatagctagcaaattaagagaacaatttggaaataataaaacaataatctttaagcaatcctcaggaggggacccagaaattgtaacgcacagttttaattgtggaggggaatttttctactgtaattcaacacaactgtttaatagtacttggtttaatagtacttggagtactgaagggtcaaataacactgaaggaagtgacacaatcacactcccatgcagaataaaacaatttataaacatgtggcaggaagtaggaaaagcaatgtatgcccctcccatcagtggacaaattagatgttcatcaaatattactgggctgctattaacaagagatggtggtaataacaacaatgggtccgagatcttcagacctggaggaggcgatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctgatatagtgcagcagcagaacaatttgctgagggctattgaggcgcaacagcatctgttgcaactcacagtctggggcatcaaacagctccaggcaagaatcctggctgtggaaagatacctaaaggatcaacagctcctggggatttggggttgctctggaaaactcatttgcaccactgctgtgccttggaatgctagttggagtaataaatctctggaacagatttggaataacatgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaatcccgaggggacccgacaggcccgaaggaatagaagaagaaggtggagagagagacagagacagatccattcgattagtgaacggatccttagcacttatctgggacgatctgcggagcctgtgcctcttcagctaccaccgcttgagagacttactcttgattgtaacgaggattgtggaacttctgggacgcagggggtgggaagccctcaaatattggtggaatctcctacagtattggagtcaggaactaaagaatagtgctgttaacttgctcaatgccacagccatagcagtagctgaggggacagatagggttatagaagtattacaagcagcttatagagctattcgccacatacctagaagaataagacagggcttggaaaggattttgctataagatgggtggcaagtggtcaaaaagtagtgtgattggatggcctgctgtaagggaaagaatgagacgagctgagccagcagcagatggggtgggagcagtatctcgagacctagaaaaacatggagcaatcacaagtagcaatacagcagctaacaatgctgcttgtgcctggctagaagcacaagaggaggaagaggtgggttttccagtcacacctcaggtacctttaagaccaatgacttacaaggcagctgtagatcttagccactttttaaaagaaaaggggggactggaagggctaattcactcccaaagaagacaagatatccttgatctgtggatctaccacacacaaggctacttccctgattggcagaactacacaccagggccaggggtcagatatccactgacctttggatggtgctacaagctagtaccagttgagccagataaggtagaagaggccaataaaggagagaacaccagcttgttacaccctgtgagcctgcatggaatggatgaccctgagagagaagtgttagagtggaggtttgacagccgcctagcatttcatcacgtggcccgagagctgcatccggagtacttcaagaactgctgacatcgagcttgctacaagggactttccgctggggactttccagggaggcgtggcctgggcgggactggggagtggcgagccctcagatgctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagca

SEQ ID NO: 112 - DNA, 8053 bp, Artificial Sequence
  Synthetic Sequence
tggaagggctaatttggtcccaaaaaagacaagagatccttgatctgtggatctaccacacacaaggctacttccctgattggcagaactacacaccagggccagggatcagatatccactgacctttggatggtgcttcaagttagtaccagttgaaccagagcaagtagaagaggccaatgaaggagagaacaacagcttgttacaccctatgagccagcatgggatggaggacccggagggagaagtattagtgtggaagtttgacagcctcctagcatttcgtcacatggcccgagagctgcatccggagtactacaaagactgctgacatcgagctttctacaagggactttccgctggggactttccagggaggtgtggcctgggcgggactggggagtggcgagccctcagatgctacatataagcagctgctttttgcctgtactgggtctctctggttagaccagatctgagcctgggagctctctggctaactagggaacccactgcttaagcctcaataaagcttgccttgagtgctcaaagtagtgtgtgcccgtctgttgtgtgactctggtaactagagatccctcagacccttttagtcagtgtggaaaatctctagcagtggcgcccgaacagggacttgaaagcgaaagtaaagccagaggagatctctcgacgcaggactcggcttgctgaagcgcgcacggcaagaggcgaggggcggcgactggtgagtacgccaaaaattttgactagcggaggctagaaggagagagatgggtgcgagagcgtcggtattaagcgggggagaattagataaatgggaaaaaattcggttaaggccagggggaaagaaacaatataaactaaaacatatagtatgggcaagcagggagctagaacgattcgcagttaatcctggccttttagagacatcagaaggctgtagacaaatactgggacagctacaaccatcccttcagacaggatcagaagaacttagatcattatataatacaatagcagtcctctattgtgtgcatcaaaggatagatgtaaaagacaccaaggaagccttagataagatagaggaagagcaaaacaaaagtaagaaaaaggcacagcaagcagcagctgacacaggaaacaacagccaggtcagccaaaattaccctatagtgcagaacctccaggggcaaatggtacatcaggccatatcacctagaactttaaatgcatgggtaaaagtagtagaagagaaggctttcagcccagaagtaatacccatgttttcagcattatcagaaggagccaccccacaagatttaaataccatgctaaacacagtggggggacatcaagcagccatgcaaatgttaaaagagaccatcaatgaggaagctgcagaatgggatagattgcatccagtgcatgcagggcctattgcaccaggccagatgagagaaccaaggggaagtgacatagcaggaactactagtacccttcaggaacaaataggatggatgacacataatccacctatcccaaccgtccatgaagggttcgatggcgaccctcggccgtggactatggcaacggcagattcgttaaatgaatttgccaggaagatggaaaccaaaaatgatagggggaattggaggttttatcaaagtaagacagtatgatcagatactcatagaaatctgcggacataaagctataggtacagtattagtaggacctacacctgtcaacataattggaagaaatctgttgactcagattggctgcactttaaattttcccattagtcctattgagactgtaccagtaaaattaaagccaggaatggatggcccaaaagttaaacaatggccattgacagaagaaaaaataaaagcattagtagaaatttgtacagaaatggaaaaggaaggaaaaatttcaaaaattgggcctgaaaatccatacaatactccagtatttgccataaagaaaaaagacagtactaaatggagaaaattagtagatttcagagaacttaataagagaactcaagatttctgggaagttcaattaggaataccacatcctgcagggttaaaacagaaaaaatcagtaacagtactggatgtgggcgatgcatatttttcagttcccttagataaagacttcaggaagtatactgcatttaccatacctagtataaacaatgagacaccagggattagatatcagtacaatgtgcttccacagggatggaaaggatcaccagcaatattccagtgtagcatgacaaaaatcttagagccttttagaaaacaaaatccagacatagtcatctatcaatacatggatgatttgtatgtaggatctgacttagaaatagggcagcatagaacaaaaatagaggaactgagacaacatctgttgaggtggggatttaccacaccagacaaaaaacatcagaaagaacctccattcctttggatgggttatgaactccatcctgataaatggacagtacagcctatagtgctgccagaaaaggacagctggactgtcaatgacatacagaaattagtgggaaaattgaattgggcaagtcagatttatgcagggattaaagtaaggcaattatgtaaacttcttaggggaaccaaagcactaacagaagtagtaccactaacagaagaagcagagctagaactggcagaaaacagggagattctaaaagaaccggtacatggagtgtattatgacccatcaaaagacttaatagcagaaatacagaagcaggggcaaggccaatggacatatcaaatttatcaagagccatttaaaaatctgaaaacaggaaagtatgcaagaatgaagggtgcccacactaatgatgtgaaacaattaacagaggcagtacaaaaaatagccacagaaagcatagtaatatggggaaagactcctaaatttaaattacccatacaaaaggaaacatgggaagcatggtggacagagtattggcaagccacctggattcctgagtgggagtttgtcaatacccctcccttagtgaagttatggtaccagttagagaaagaacccataataggagcagaaactttctatgtagatggggcagccaatagggaaactaaattaggaaaagcaggatatgtaactgacagaggaagacaaaaagttgtccccctaacggacacaacaaatcagaagactgagttacaagcaattcatctagctttgcaggattcgggattagaagtaaacatagtgacagactcacaatatgcattgggaatcattcaagcacaaccagataagagtgaatcagagttagtcagtcaaataatagagcagttaataaaaaaggaaaaagtctacctggcatgggtaccagcacacaaaggaattggaggaaatgaacaagtagataaattggtcagtgctggaatcaggaaagtactatttttagatggaatagataaggcccaagaagaacatgagaaatatcacagtaattggagagcaatggctagtgattttaacctaccacctgtagtagcaaaagaaatagtagccagctgtgataaatgtcagctaaaaggggaagccatgcatggacaagtagactgtagcccaggaatatggcagctagattgtacacatttagaaggaaaagttatcttggtagcagttcatgtagccagtggatatatagaagcagaagtaattccagcagagacagggcaagaaacagcatacttcctcttaaaattagcaggaagatggccagtaaaaacagtacatacagacaatggcagcaatttcaccagtactacagttaaggccgcctgttggtgggcggggatcaagcaggaatttggcattccctacaatccccaaagtcaaggagtaatagaatctatgaataaagaattaaagaaaattataggacaggtaagagatcaggctgaacatcttaagacagcagtacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggaaaggaccagcaaagctcctctggaaaggtgaaggggcagtagtaatacaagataatagtgacataaaagtagtgccaagaagaaaagcaaagatcatcagggattatggaaaacagatggcaggtgatgattgtgtggcccgtccatgaagggttcgattcttgaacagcgcggtctgttatggcaacggcagattcgtttaatgcaacctataatagtagcaatagtagcattagtagtagcaataataatagcaatagttgtgtggtccatagtaatcatagaatataggaaaatattaagacaaagaaaaatagacaggttaattgatagactaatagaaagagcagaagacagtggcaatgagagtgaaggagaagtatcagcacttgtggagatgggggtggaaatggggcaccatgctccttgggatattgatgatctgtagtgctacagaaaaattgtgggtcacagtctattatggggtacctgtgtggaaggaagcaaccaccactctattttgtgcatcagatgctaaagcatatgatacagaggtacataatgtttgggccacacatgcctgtgtacccacagaccccaacccacaagaagtagtattggtaaatgtgacagaaaattttaacatgtggaaaaatgacatggtagaacagatgcatgaggatataatcagtttatgggatcaaagcctaaagccatgtgtaaaattaaccccactctgtgttagtttaaagtgcactgatttgaagaatgatactaataccaatagtagtagcgggagaatgataatggagaaaggagagataaaaaactgctctttcaatatcagcacaagcataagagataaggtgcagaaagaatatgcattcttttataaacttgatatagtaccaatagataataccagctataggttgataagttgtaacacctcagtcattacacaggcctgtccaaaggtatcctttgagccaattcccatacattattgtgccccggctggttttgcgattctaaaatgtaataataagacgttcaatggaacaggaccatgtacaaatgtcagcacagtacaatgtacacatggaatcaggccagtagtatcaactcaactgctgttaaatggcagtctagcagaagaagatgtagtaattagatctgccaatttcacagacaatgctaaaaccataatagtacagctgaacacatctgtagaaattaattgtacaagacccaacaacaatacaagaaaaagtatccgtatccagaggggaccagggagagcatttgttacaataggaaaaataggaaatatgagacaagcacattgtaacattagtagagcaaaatggaatgccactttaaaacagatagctagcaaattaagagaacaatttggaaataataaaacaataatctttaagcaatcctcaggaggggacccagaaattgtaacgcacagttttaattgtggaggggaatttttctactgtaattcaacacaactgtttaatagtacttggtttaatagtacttggagtactgaagggtcaaataacactgaaggaagtgacacaatcacactcccatgcagaataaaacaatttataaacatgtggcaggaagtaggaaaagcaatgtatgcccctcccatcagtggacaaattagatgttcatcaaatattactgggctgctattaacaagagatggtggtaataacaacaatgggtccgagatcttcagacctggaggaggcgatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctgatatagtgcagcagcagaacaatttgctgagggctattgaggcgcaacagcatctgttgcaactcacagtctggggcatcaaacagctccaggcaagaatcctggctgtggaaagatacctaaaggatcaacagctcctggggatttggggttgctctggaaaactcatttgcaccactgctgtgccttggaatgctagttggagtaataaatctctggaacagatttggaataacatgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaatcccgaggggacccgacaggcccgaaggaatagaagaagaaggtggagagagagacagagacagatccattcgattagtgaacggatccttagcacttatctgggacgatctgcggagcctgtgcctcttcagctaccaccgcttgagagacttactcttgattgtaacgaggattgtggaacttctgggacgcagggggtgggaagccctcaaatattggtggaatctcctacagtattggagtcaggaactaaagaatagtgctgttaacttgctcaatgccacagccatagcagtagctgaggggacagatagggttatagaagtattacaagcagcttatagagctattcgccacatacctagaagaataagacagggcttggaaaggattttgctataagatgggtggcaagtggtcaaaaagtagtgtgattggatggcctgctgtaagggaaagaatgagacgagctgagccagcagcagatggggtgggagcagtatctcgagacctagaaaaacatggagcaatcacaagtagcaatacagcagctaacaatgctgcttgtgcctggctagaagcacaagaggaggaagaggtgggttttccagtcacacctcaggtacctttaagaccaatgacttacaaggcagctgtagatcttagccactttttaaaagaaaaggggggactggaagggctaattcactcccaaagaagacaagatatccttgatctgtggatctaccacacacaaggctacttccctgattggcagaactacacaccagggccaggggtcagatatccactgacctttggatggtgctacaagctagtaccagttgagccagataaggtagaagaggccaataaaggagagaacaccagcttgttacaccctgtgagcctgcatggaatggatgaccctgagagagaagtgttagagtggaggtttgacagccgcctagcatttcatcacgtggcccgagagctgcatccggagtacttcaagaactgctgacatcgagcttgctacaagggactttccgctggggactttccagggaggcgtggcctgggcgggactggggagtggcgagccctcagatgctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagca

SEQ ID NO: 113 - DNA, 7828 bp, Artificial Sequence
  Synthetic Sequence
tggaagggctaatttggtcccaaaaaagacaagagatccttgatctgtggatctaccacacacaaggctacttccctgattggcagaactacacaccagggccagggatcagatatccactgacctttggatggtgcttcaagttagtaccagttgaaccagagcaagtagaagaggccaatgaaggagagaacaacagcttgttacaccctatgagccagcatgggatggaggacccggagggagaagtattagtgtggaagtttgacagcctcctagcatttcgtcacatggcccgagagctgcatccggagtactacaaagactgctgacatcgagctttctacaagggactttccgctggggactttccagggaggtgtggcctgggcgggactggggagtggcgagccctcagatgctacatataagcagctgctttttgcctgtactgggtctctctggttagaccagatctgagcctgggagctctctggctaactagggaacccactgcttaagcctcaataaagcttgccttgagtgctcaaagtagtgtgtgcccgtctgttgtgtgactctggtaactagagatccctcagacccttttagtcagtgtggaaaatctctagcagtggcgcccgaacagggacttgaaagcgaaagtaaagccagaggagatctctcgacgcaggactcggcttgctgaagcgcgcacggcaagaggcgaggggcggcgactggtgagtacgccaaaaattttgactagcggaggctagaaggagagagatgggtgcgagagcgtcggtattaagcgggggagaattagataaatgggaaaaaattcggttaaggccagggggaaagaaacaatataaactaaaacatatagtatgggcaagcagggagctagaacgattcgcagttaatcctggccttttagagacatcagaaggctgtagacaaatactgggacagctacaaccatcccttcagacaggatcagaagaacttagatcattatataatacaatagcagtcctctattgtgtgcatcaaaggatagatgtaaaagacaccaaggaagccttagataagatagaggaagagcaaaacaaaagtaagaaaaaggcacagcaagcagcagctgacacaggaaacaacagccaggtcagccaaaattaccctatagtgcagaacctccaggggcaaatggtacatcaggccatatcacctagaactttaaatgcatgggtaaaagtagtagaagagaaggctttcagcccagaagtaatacccatgttttcagcattatcagaaggagccaccccacaagatttaaataccatgctaaacacagtggggggacatcaagcagccatgcaaatgttaaaagagaccatcaatgaggaagctgcagaatgggatagattgcatccagtgcatgcagggcctattgcaccaggccagatgagagaaccaaggggaagtgacatagcaggaactactagtacccttcaggaacaaataggatggatgacacataatccacctatcccaaccgtccatgaagggttcgatggcgaccctcggccgtggactatggcaacggcagattcgttaaatgaatttgccaggaagatggaaaccaaaaatgatagggggaattggaggttttatcaaagtaagacagtatgatcagatactcatagaaatctgcggacataaagctataggtacagtattagtaggacctacacctgtcaacataattggaagaaatctgttgactcagattggctgcactttaaattttcccattagtcctattgagactgtaccagtaaaattaaagccaggaatggatggcccaaaagttaaacaatggccattgacagaagaaaaaataaaagcattagtagaaatttgtacagaaatggaaaaggaaggaaaaatttcaaaaattgggcctgaaaatccatacaatactccagtatttgccataaagaaaaaagacagtactaaatggagaaaattagtagatttcagagaacttaataagagaactcaagatttctgggaagttcaattaggaataccacatcctgcagggttaaaacagaaaaaatcagtaacagtactggatgtgggcgatgcatatttttcagttcccttagataaagacttcaggaagtatactgcatttaccatacctagtataaacaatgagacaccagggattagatatcagtacaatgtgcttccacagggatggaaaggatcaccagcaatattccagtgtagcatgacaaaaatcttagagccttttagaaaacaaaatccagacatagtcatctatcaatacatggatgatttgtatgtaggatctgacttagaaatagggcagcatagaacaaaaatagaggaactgagacaacatctgttgaggtggggatttaccacaccagacaaaaaacatcagaaagaacctccattcctttggatgggttatgaactccatcctgataaatggacagtacagcctatagtgctgccagaaaaggacagctggactgtcaatgacatacagaaattagtgggaaaattgaattgggcaagtcagatttatgcagggattaaagtaaggcaattatgtaaacttcttaggggaaccaaagcactaacagaagtagtaccactaacagaagaagcagagctagaactggcagaaaacagggagattctaaaagaaccggtacatggagtgtattatgacccatcaaaagacttaatagcagaaatacagaagcaggggcaaggccaatggacatatcaaatttatcaagagccatttaaaaatctgaaaacaggaaagtatgcaagaatgaagggtgcccacactaatgatgtgaaacaattaacagaggcagtacaaaaaatagccacagaaagcatagtaatatggggaaagactcctaaatttaaattacccatacaaaaggaaacatgggaagcatggtggacagagtattggcaagccacctggattcctgagtgggagtttgtcaatacccctcccttagtgaagttatggtaccagttagagaaagaacccataataggagcagaaactttctatgtagatggggcagccaatagggaaactaaattaggaaaagcaggatatgtaactgacagaggaagacaaaaagttgtccccctaacggacacaacaaatcagaagactgagttacaagcaattcatctagctttgcaggattcgggattagaagtaaacatagtgacagactcacaatatgcattgggaatcattcaagcacaaccagataagagtgaatcagagttagtcagtcaaataatagagcagttaataaaaaaggaaaaagtctacctggcatgggtaccagcacacaaaggaattggaggaaatgaacaagtagataaattggtcagtgctggaatcaggaaagtactatttttagatggaatagataaggcccaagaagaacatgagaaatatcacagtaattggagagcaatggctagtgattttaacctaccacctgtagtagcaaaagaaatagtagccagctgtgataaatgtcagctaaaaggggaagccatgcatggacaagtagactgtagcccaggaatatggcagctagattgtacacatttagaaggaaaagttatcttggtagcagttcatgtagccagtggatatatagaagcagaagtaattccagcagagacagggcaagaaacagcatacttcctcttaaaattagcaggaagatggccagtaaaaacagtacatacagacaatggcagcaatttcaccagtactacagttaaggccgcctgttggtgggcggggatcaagcaggaatttggcattccctacaatccccaaagtcaaggagtaatagaatctatgaataaagaattaaagaaaattataggacaggtaagagatcaggctgaacatcttaagacagcagtacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggaaaggaccagcaaagctcctctggaaaggtgaaggggcagtagtaatacaagataatagtgacataaaagtagtgccaagaagaaaagcaaagatcatcagggattaaccgtccatgaagggttcgattatctgtagccaacattcgatatggcaacggcagattcgttggagatgggggtggaaatggggcaccatgctccttgggatattgatgatctgtagtgctacagaaaaattgtgggtcacagtctattatggggtacctgtgtggaaggaagcaaccaccactctattttgtgcatcagatgctaaagcatatgatacagaggtacataatgtttgggccacacatgcctgtgtacccacagaccccaacccacaagaagtagtattggtaaatgtgacagaaaattttaacatgtggaaaaatgacatggtagaacagatgcatgaggatataatcagtttatgggatcaaagcctaaagccatgtgtaaaattaaccccactctgtgttagtttaaagtgcactgatttgaagaatgatactaataccaatagtagtagcgggagaatgataatggagaaaggagagataaaaaactgctctttcaatatcagcacaagcataagagataaggtgcagaaagaatatgcattcttttataaacttgatatagtaccaatagataataccagctataggttgataagttgtaacacctcagtcattacacaggcctgtccaaaggtatcctttgagccaattcccatacattattgtgccccggctggttttgcgattctaaaatgtaataataagacgttcaatggaacaggaccatgtacaaatgtcagcacagtacaatgtacacatggaatcaggccagtagtatcaactcaactgctgttaaatggcagtctagcagaagaagatgtagtaattagatctgccaatttcacagacaatgctaaaaccataatagtacagctgaacacatctgtagaaattaattgtacaagacccaacaacaatacaagaaaaagtatccgtatccagaggggaccagggagagcatttgttacaataggaaaaataggaaatatgagacaagcacattgtaacattagtagagcaaaatggaatgccactttaaaacagatagctagcaaattaagagaacaatttggaaataataaaacaataatctttaagcaatcctcaggaggggacccagaaattgtaacgcacagttttaattgtggaggggaatttttctactgtaattcaacacaactgtttaatagtacttggtttaatagtacttggagtactgaagggtcaaataacactgaaggaagtgacacaatcacactcccatgcagaataaaacaatttataaacatgtggcaggaagtaggaaaagcaatgtatgcccctcccatcagtggacaaattagatgttcatcaaatattactgggctgctattaacaagagatggtggtaataacaacaatgggtccgagatcttcagacctggaggaggcgatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctgatatagtgcagcagcagaacaatttgctgagggctattgaggcgcaacagcatctgttgcaactcacagtctggggcatcaaacagctccaggcaagaatcctggctgtggaaagatacctaaaggatcaacagctcctggggatttggggttgctctggaaaactcatttgcaccactgctgtgccttggaatgctagttggagtaataaatctctggaacagatttggaataacatgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaatcccgaggggacccgacaggcccgaaggaatagaagaagaaggtggagagagagacagagacagatccattcgattagtgaacggatccttagcacttatctgggacgatctgcggagcctgtgcctcttcagctaccaccgcttgagagacttactcttgattgtaacgaggattgtggaacttctgggacgcagggggtgggaagccctcaaatattggtggaatctcctacagtattggagtcaggaactaaagaatagtgctgttaacttgctcaatgccacagccatagcagtagctgaggggacagatagggttatagaagtattacaagcagcttatagagctattcgccacatacctagaagaataagacagggcttggaaaggattttgctataagatgggtggcaagtggtcaaaaagtagtgtgattggatggcctgctgtaagggaaagaatgagacgagctgagccagcagcagatggggtgggagcagtatctcgagacctagaaaaacatggagcaatcacaagtagcaatacagcagctaacaatgctgcttgtgcctggctagaagcacaagaggaggaagaggtgggttttccagtcacacctcaggtacctttaagaccaatgacttacaaggcagctgtagatcttagccactttttaaaagaaaaggggggactggaagggctaattcactcccaaagaagacaagatatccttgatctgtggatctaccacacacaaggctacttccctgattggcagaactacacaccagggccaggggtcagatatccactgacctttggatggtgctacaagctagtaccagttgagccagataaggtagaagaggccaataaaggagagaacaccagcttgttacaccctgtgagcctgcatggaatggatgaccctgagagagaagtgttagagtggaggtttgacagccgcctagcatttcatcacgtggcccgagagctgcatccggagtacttcaagaactgctgacatcgagcttgctacaagggactttccgctggggactttccagggaggcgtggcctgggcgggactggggagtggcgagccctcagatgctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagca

SEQ ID NO: 114 - DNA, 8052 bp, Artificial Sequence
  Synthetic Sequence
tggaagggctaatttggtcccaaaaaagacaagagatccttgatctgtggatctaccacacacaaggctacttccctgattggcagaactacacaccagggccagggatcagatatccactgacctttggatggtgcttcaagttagtaccagttgaaccagagcaagtagaagaggccaatgaaggagagaacaacagcttgttacaccctatgagccagcatgggatggaggacccggagggagaagtattagtgtggaagtttgacagcctcctagcatttcgtcacatggcccgagagctgcatccggagtactacaaagactgctgacatcgagctttctacaagggactttccgctggggactttccagggaggtgtggcctgggcgggactggggagtggcgagccctcagatgctacatataagcagctgctttttgcctgtactgggtctctctggttagaccagatctgagcctgggagctctctggctaactagggaacccactgcttaagcctcaataaagcttgccttgagtgctcaaagtagtgtgtgcccgtctgttgtgtgactctggtaactagagatccctcagacccttttagtcagtgtggaaaatctctagcagtggcgcccgaacagggacttgaaagcgaaagtaaagccagaggagatctctcgacgcaggactcggcttgctgaagcgcgcacggcaagaggcgaggggcggcgactggtgagtacgccaaaaattttgactagcggaggctagaaggagagagatgggtgcgagagcgtcggtattaagcgggggagaattagataaatgggaaaaaattcggttaaggccagggggaaagaaacaatataaactaaaacatatagtatgggcaagcagggagctagaacgattcgcagttaatcctggccttttagagacatcagaaggctgtagacaaatactgggacagctacaaccatcccttcagacaggatcagaagaacttagatcattatataatacaatagcagtcctctattgtgtgcatcaaaggatagatgtaaaagacaccaaggaagccttagataagatagaggaagagcaaaacaaaagtaagaaaaaggcacagcaagcagcagctgacacaggaaacaacagccaggtcagccaaaattaccctatagtgcagaacctccaggggcaaatggtacatcaggccatatcacctagaactttaaatgcatgggtaaaagtagtagaagagaaggctttcagcccagaagtaatacccatgttttcagcattatcagaaggagccaccccacaagatttaaataccatgctaaacacagtggggggacatcaagcagccatgcaaatgttaaaagagaccatcaatgaggaagctgcagaatgggatagattgcatccagtgcatgcagggcctattgcaccaggccagatgagagaaccaaggggaagtgacatagcaggaactactagtacccttcaggaacaaataggatggatgacacataatccacctatcccaaccgtccatgaagggttcgatggcgaccctcggccgtggactatggcaacggcagattcgttaaatgaatttgccaggaagatggaaaccaaaaatgatagggggaattggaggttttatcaaagtaagacagtatgatcagatactcatagaaatctgcggacataaagctataggtacagtattagtaggacctacacctgtcaacataattggaagaaatctgttgactcagattggctgcactttaaattttcccattagtcctattgagactgtaccagtaaaattaaagccaggaatggatggcccaaaagttaaacaatggccattgacagaagaaaaaataaaagcattagtagaaatttgtacagaaatggaaaaggaaggaaaaatttcaaaaattgggcctgaaaatccatacaatactccagtatttgccataaagaaaaaagacagtactaaatggagaaaattagtagatttcagagaacttaataagagaactcaagatttctgggaagttcaattaggaataccacatcctgcagggttaaaacagaaaaaatcagtaacagtactggatgtgggcgatgcatatttttcagttcccttagataaagacttcaggaagtatactgcatttaccatacctagtataaacaatgagacaccagggattagatatcagtacaatgtgcttccacagggatggaaaggatcaccagcaatattccagtgtagcatgacaaaaatcttagagccttttagaaaacaaaatccagacatagtcatctatcaatacatggatgatttgtatgtaggatctgacttagaaatagggcagcatagaacaaaaatagaggaactgagacaacatctgttgaggtggggatttaccacaccagacaaaaaacatcagaaagaacctccattcctttggatgggttatgaactccatcctgataaatggacagtacagcctatagtgctgccagaaaaggacagctggactgtcaatgacatacagaaattagtgggaaaattgaattgggcaagtcagatttatgcagggattaaagtaaggcaattatgtaaacttcttaggggaaccaaagcactaacagaagtagtaccactaacagaagaagcagagctagaactggcagaaaacagggagattctaaaagaaccggtacatggagtgtattatgacccatcaaaagacttaatagcagaaatacagaagcaggggcaaggccaatggacatatcaaatttatcaagagccatttaaaaatctgaaaacaggaaagtatgcaagaatgaacgaatctgccgttgccatatacagcatctgaacaagctgatcgaacccttcatggacggttaaggccgcctgttggtgggcggggatcaagcaggaatttggcattccctacaatccccaaagtcaaggagtaatagaatctatgaataaagaattaaagaaaattataggacaggtaagagatcaggctgaacatcttaagacagcagtacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggaaaggaccagcaaagctcctctggaaaggtgaaggggcagtagtaatacaagataatagtgacataaaagtagtgccaagaagaaaagcaaagatcatcagggattatggaaaacagatggcaggtgatgattgtgtggcaagtagacaggatgaggattaacacatggaaaagattagtaaaacaccatatgtatatttcaaggaaagctaaggactggttttatagacatcactatgaaagtactaatccaaaaataagttcagaagtacacatcccactaggggatgctaaattagtaataacaacatattggggtctgcatacaggagaaagagactggcatttgggtcagggagtctccatagaatggaggaaaaagagatatagcacacaagtagaccctgacctagcagaccaactaattcatctgcactattttgattgtttttcagaatctgctataagaaataccatattaggacgtatagttagtcctaggtgtgaatatcaagcaggacataacaaggtaggatctctacagtacttggcactagcagcattaataaaaccaaaacagataaagccacctttgcctagtgttaggaaactgacagaggacagatggaacaagccccagaagaccaagggccacagagggagccatacaatgaatggacactagagcttttagaggaacttaagagtgaagctgttagacattttcctaggatatggctccataacttaggacaacatatctatgaaacttacggggatacttgggcaggagtggaagccataataagaattctgcaacaactgctgtttatccatttcagaattgggtgtcgacatagcagaataggcgttactcgacagaggagagcaagaaatggagccagtagatcctagactagagccctggaagcatccaggaagtcagcctaaaactgcttgtaccaattgctattgtaaaaagtgttgctttcattgccaagtttgtttcatgacaaaagccttaggcatctcctatggcaggaagaagcggagacagcgacgaagagctcatcagaacagtcagactcatcaagcttctctatcaaagcagtaagtagtacatgtaatgcaacctataatagtagcaatagtagcattagtagtagcaataataatagcaatagttgtgtggtccatagtaatcatagaatataggaaaatattaagacaaagaaaaatagacaggttaattgatagactaatagaaagagcagaagacagtggcaatgagagtgaaggagaagtatcagcacttgtggagatgggggtggaaatggggcaccatgctccttgggatattgatgatctgtagtgctacagaaaaattgtgggtcacagtctattatggggtacctgtgtggaaggaagcaaccaccactctattttgtgcatcagatgctaaagcatatgatacagaggtacataatgtttgggccacacatgcctgtgtacccacagaccccaacccacaagaagtagtattggtaaatgtgacagaaaattttaacatgtggaaaaatgacatggtagaacagatgcatgaggatataatcagtttatgggatcaaagcctaaagccatgtgtaaaattaaccccactctgtgttagtttaaagtgcactgatttgaagaatgatactaataccaatagtagtagcgggagaatgataatggagaaaggagagataaaaaactgctctttcaatatcagcacaagcataagagataaggtgcagaaagaatatgcattcttttataaacttgatatagtaccaatagataataccagctataggttgataagttgtaacacctcagtcattacacaggcctgtccaaaggtatcctttgagccaattcccatacattattgtgccccggctggttttgcgattctaaaatgtaataataagacgttcaatggaacaggaccatgtacaaatgtcagcacagtacaatgtacacatggaatcaggccagtagtatcaactcaactgctgttaaatggcagtctagcagaagaagatgtagtaattagatctgccaatttcacagacaatgctaaaaccataatagtacagctgaacacatctgtagaaattaattgtacaagacccaacaacaatacaagaaaaagtatccgtatccagaggggaccagggagagcatttgttacaataggaaaaataggaaatatgagacaagcacattgtaacattagtagagcaaaatggaatgccactttaaaacagatagctagcaaattaagagaacaatttggaaataataaaacaataatctttaagcaatcctcaggaggggacccagaaattgtaacgcacagttttaattgtggaggggaatttttctactgtaattcaacacaactgtttaatagtacttggtttaatagtacttggagtactgaagggtcaaataacactgaaggaagtgacacaatcacactcccatgcagaataaaacaatttataaacatgtggcaggaagtaggaaaagcaatgtatgcccctcccatcagtggacaaattagatgttcatcaaatattactgggctgctattaacaagagatggtggtaataacaacaatgggtccgagatcttcagacctggaggaggcgatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctgatatagtgcagcagcagaacaatttgctgagggctattgaggcgcaacagcatctgttgcaactcacagtctggggcatcaaacagctccaggcaagaatcctggctgtggaaagatacctaaaggatcaacagctcctggggatttggggttgctctggaaaactcatttgcaccactgctgtgccttggaatgctagttggagtaataaatctctggaacagatttggaataacatgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaatcccgaggggacccgacaggcccgaaggaatagaagaagaaggtggagagagagacagagacagatccattcgattagtgaacggatccttagcacttatctgggacgatctgcggagcctgtgcctcttcagctaccaccgcttgagagacttactcttgattgtaacgaggattgtggaacttctgggacgcagggggtgggaagccctcaaatattggtggaatctcctacagtattggagtcaggaactaaagaatagtgctgttaacttgctcaatgccacagccatagcagtagctgaggggacagatagggttatagaagtattacaagcagcttatagagctattcgccacatacctagaagaataagacagggcttggaaaggattttgctataagatgggtggcaagtggtcaaaaagtagtgtgattggatggcctgctgtaagggaaagaatgagacgagctgagccagcagcagatggggtgggagcagtatctcgagacctagaaaaacatggagcaatcacaagtagcaatacagcagctaacaatgctgcttgtgcctggctagaagcacaagaggaggaagaggtgggttttccagtcacacctcaggtacctttaagaccaatgacttacaaggcagctgtagatcttagccactttttaaaagaaaaggggggactggaagggctaattcactcccaaagaagacaagatatccttgatctgtggatctaccacacacaaggctacttccctgattggcagaactacacaccagggccaggggtcagatatccactgacctttggatggtgctacaagctagtaccagttgagccagataaggtagaagaggccaataaaggagagaacaccagcttgttacaccctgtgagcctgcatggaatggatgaccctgagagagaagtgttagagtggaggtttgacagccgcctagcatttcatcacgtggcccgagagctgcatccggagtacttcaagaactgctgacatcgagcttgctacaagggactttccgctggggactttccagggaggcgtggcctgggcgggactggggagtggcgagccctcagatgctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagca

SEQ ID NO: 115 - DNA, 7129 bp, Artificial Sequence
  Synthetic Sequence
tggaagggctaatttggtcccaaaaaagacaagagatccttgatctgtggatctaccacacacaaggctacttccctgattggcagaactacacaccagggccagggatcagatatccactgacctttggatggtgcttcaagttagtaccagttgaaccagagcaagtagaagaggccaatgaaggagagaacaacagcttgttacaccctatgagccagcatgggatggaggacccggagggagaagtattagtgtggaagtttgacagcctcctagcatttcgtcacatggcccgagagctgcatccggagtactacaaagactgctgacatcgagctttctacaagggactttccgctggggactttccagggaggtgtggcctgggcgggactggggagtggcgagccctcagatgctacatataagcagctgctttttgcctgtactgggtctctctggttagaccagatctgagcctgggagctctctggctaactagggaacccactgcttaagcctcaataaagcttgccttgagtgctcaaagtagtgtgtgcccgtctgttgtgtgactctggtaactagagatccctcagacccttttagtcagtgtggaaaatctctagcagtggcgcccgaacagggacttgaaagcgaaagtaaagccagaggagatctctcgacgcaggactcggcttgctgaagcgcgcacggcaagaggcgaggggcggcgactggtgagtacgccaaaaattttgactagcggaggctagaaggagagagatgggtgcgagagcgtcggtattaagcgggggagaattagataaatgggaaaaaattcggttaaggccagggggaaagaaacaatataaactaaaacatatagtatgggcaagcagggagctagaacgattcgcagttaatcctggccttttagagacatcagaaggctgtagacaaatactgggacagctacaaccatcccttcagacaggatcagaagaacttagatcattatataatacaatagcagtcctctattgtgtgcatcaaaggatagatgtaaaagacaccaaggaagccttagataagatagaggaagagcaaaacaaaagtaagaaaaaggcacagcaagcagcagctgacacaggaaacaacagccaggtcagccaaaattaccctatagtgcagaacctccaggggcaaatggtacatcaggccatatcacctagaactttaaatgcatgggtaaaagtagtagaagagaaggctttcagcccagaagtaatacccatgttttcagcattatcagaaggagccaccccacaagatttaaataccatgctaaacacagtggggggacatcaagcagccatgcaaatgttaaaagagaccatcaatgaggaagctgcagaatgggatagattgcatccagtgcatgcagggcctattgcaccaggccagatgagagaaccaaggggaagtgacatagcaggaactactagtacccttcaggaacaaataggatggatgacacataatccacctatcccaaccgtccatgaagggttcgatggcgaccctcggccgtggactatggcaacggcagattcgttaaatgaatttgccaggaagatggaaaccaaaaatgatagggggaattggaggttttatcaaagtaagacagtatgatcagatactcatagaaatctgcggacataaagctataggtacagtattagtaggacctacacctgtcaacataattggaagaaatctgttgactcagattggctgcactttaaattttcccattagtcctattgagactgtaccagtaaaattaaagccaggaatggatggcccaaaagttaaacaatggccattgacagaagaaaaaataaaagcattagtagaaatttgtacagaaatggaaaaggaaggaaaaatttcaaaaattgggcctgaaaatccatacaatactccagtatttgccataaagaaaaaagacagtactaaatggagaaaattagtagatttcagagaacttaataagagaactcaagatttctgggaagttcaattaggaataccacatcctgcagggttaaaacagaaaaaatcagtaacagtactggatgtgggcgatgcatatttttcagttcccttagataaagacttcaggaagtatactgcatttaccatacctagtataaacaatgagacaccagggattagatatcagtacaatgtgcttccacagggatggaaaggatcaccagcaatattccagtgtagcatgacaaaaatcttagagccttttagaaaacaaaatccagacatagtcatctatcaatacatggatgatttgtatgtaggatctgacttagaaatagggcagcatagaacaaaaatagaggaactgagacaacatctgttgaggtggggatttaccacaccagacaaaaaacatcagaaagaacctccattcctttggatgggttatgaactccatcctgataaatggacagtacagcctatagtgctgccagaaaaggacagctggactgtcaatgacatacagaaattagtgggaaaattgaattgggcaagtcagatttatgcagggattaaagtaaggcaattatgtaaacttcttaggggaaccaaagcactaacagaagtagtaccactaacagaagaagcagagctagaactggcagaaaacagggagattctaaaagaaccggtacatggagtgtattatgacccatcaaaagacttaatagcagaaatacagaagcaggggcaaggccaatggacatatcaaatttatcaagagccatttaaaaatctgaaaacaggaaagtatgcaagaatgaacgaatctgccgttgccatatacagcatctgaacaagctgatcgaacccttcatggacggttaaggccgcctgttggtgggcggggatcaagcaggaatttggcattccctacaatccccaaagtcaaggagtaatagaatctatgaataaagaattaaagaaaattataggacaggtaagagatcaggctgaacatcttaagacagcagtacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggaaaggaccagcaaagctcctctggaaaggtgaaggggcagtagtaatacaagataatagtgacataaaagtagtgccaagaagaaaagcaaagatcatcagggattatggaaaacagatggcaggtgatgattgtgtggcccgtccatgaagggttcgattcttgaacagcgcggtctgttatggcaacggcagattcgtttaatgcaacctataatagtagcaatagtagcattagtagtagcaataataatagcaatagttgtgtggtccatagtaatcatagaatataggaaaatattaagacaaagaaaaatagacaggttaattgatagactaatagaaagagcagaagacagtggcaatgagagtgaaggagaagtatcagcacttgtggagatgggggtggaaatggggcaccatgctccttgggatattgatgatctgtagtgctacagaaaaattgtgggtcacagtctattatggggtacctgtgtggaaggaagcaaccaccactctattttgtgcatcagatgctaaagcatatgatacagaggtacataatgtttgggccacacatgcctgtgtacccacagaccccaacccacaagaagtagtattggtaaatgtgacagaaaattttaacatgtggaaaaatgacatggtagaacagatgcatgaggatataatcagtttatgggatcaaagcctaaagccatgtgtaaaattaaccccactctgtgttagtttaaagtgcactgatttgaagaatgatactaataccaatagtagtagcgggagaatgataatggagaaaggagagataaaaaactgctctttcaatatcagcacaagcataagagataaggtgcagaaagaatatgcattcttttataaacttgatatagtaccaatagataataccagctataggttgataagttgtaacacctcagtcattacacaggcctgtccaaaggtatcctttgagccaattcccatacattattgtgccccggctggttttgcgattctaaaatgtaataataagacgttcaatggaacaggaccatgtacaaatgtcagcacagtacaatgtacacatggaatcaggccagtagtatcaactcaactgctgttaaatggcagtctagcagaagaagatgtagtaattagatctgccaatttcacagacaatgctaaaaccataatagtacagctgaacacatctgtagaaattaattgtacaagacccaacaacaatacaagaaaaagtatccgtatccagaggggaccagggagagcatttgttacaataggaaaaataggaaatatgagacaagcacattgtaacattagtagagcaaaatggaatgccactttaaaacagatagctagcaaattaagagaacaatttggaaataataaaacaataatctttaagcaatcctcaggaggggacccagaaattgtaacgcacagttttaattgtggaggggaatttttctactgtaattcaacacaactgtttaatagtacttggtttaatagtacttggagtactgaagggtcaaataacactgaaggaagtgacacaatcacactcccatgcagaataaaacaatttataaacatgtggcaggaagtaggaaaagcaatgtatgcccctcccatcagtggacaaattagatgttcatcaaatattactgggctgctattaacaagagatggtggtaataacaacaatgggtccgagatcttcagacctggaggaggcgatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctgatatagtgcagcagcagaacaatttgctgagggctattgaggcgcaacagcatctgttgcaactcacagtctggggcatcaaacagctccaggcaagaatcctggctgtggaaagatacctaaaggatcaacagctcctggggatttggggttgctctggaaaactcatttgcaccactgctgtgccttggaatgctagttggagtaataaatctctggaacagatttggaataacatgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaatcccgaggggacccgacaggcccgaaggaatagaagaagaaggtggagagagagacagagacagatccattcgattagtgaacggatccttagcacttatctgggacgatctgcggagcctgtgcctcttcagctaccaccgcttgagagacttactcttgattgtaacgaggattgtggaacttctgggacgcagggggtgggaagccctcaaatattggtggaatctcctacagtattggagtcaggaactaaagaatagtgctgttaacttgctcaatgccacagccatagcagtagctgaggggacagatagggttatagaagtattacaagcagcttatagagctattcgccacatacctagaagaataagacagggcttggaaaggattttgctataagatgggtggcaagtggtcaaaaagtagtgtgattggatggcctgctgtaagggaaagaatgagacgagctgagccagcagcagatggggtgggagcagtatctcgagacctagaaaaacatggagcaatcacaagtagcaatacagcagctaacaatgctgcttgtgcctggctagaagcacaagaggaggaagaggtgggttttccagtcacacctcaggtacctttaagaccaatgacttacaaggcagctgtagatcttagccactttttaaaagaaaaggggggactggaagggctaattcactcccaaagaagacaagatatccttgatctgtggatctaccacacacaaggctacttccctgattggcagaactacacaccagggccaggggtcagatatccactgacctttggatggtgctacaagctagtaccagttgagccagataaggtagaagaggccaataaaggagagaacaccagcttgttacaccctgtgagcctgcatggaatggatgaccctgagagagaagtgttagagtggaggtttgacagccgcctagcatttcatcacgtggcccgagagctgcatccggagtacttcaagaactgctgacatcgagcttgctacaagggactttccgctggggactttccagggaggcgtggcctgggcgggactggggagtggcgagccctcagatgctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagca

SEQ ID NO: 116 - DNA, 6904 bp, Artificial Sequence
  Synthetic Sequence
tggaagggctaatttggtcccaaaaaagacaagagatccttgatctgtggatctaccacacacaaggctacttccctgattggcagaactacacaccagggccagggatcagatatccactgacctttggatggtgcttcaagttagtaccagttgaaccagagcaagtagaagaggccaatgaaggagagaacaacagcttgttacaccctatgagccagcatgggatggaggacccggagggagaagtattagtgtggaagtttgacagcctcctagcatttcgtcacatggcccgagagctgcatccggagtactacaaagactgctgacatcgagctttctacaagggactttccgctggggactttccagggaggtgtggcctgggcgggactggggagtggcgagccctcagatgctacatataagcagctgctttttgcctgtactgggtctctctggttagaccagatctgagcctgggagctctctggctaactagggaacccactgcttaagcctcaataaagcttgccttgagtgctcaaagtagtgtgtgcccgtctgttgtgtgactctggtaactagagatccctcagacccttttagtcagtgtggaaaatctctagcagtggcgcccgaacagggacttgaaagcgaaagtaaagccagaggagatctctcgacgcaggactcggcttgctgaagcgcgcacggcaagaggcgaggggcggcgactggtgagtacgccaaaaattttgactagcggaggctagaaggagagagatgggtgcgagagcgtcggtattaagcgggggagaattagataaatgggaaaaaattcggttaaggccagggggaaagaaacaatataaactaaaacatatagtatgggcaagcagggagctagaacgattcgcagttaatcctggccttttagagacatcagaaggctgtagacaaatactgggacagctacaaccatcccttcagacaggatcagaagaacttagatcattatataatacaatagcagtcctctattgtgtgcatcaaaggatagatgtaaaagacaccaaggaagccttagataagatagaggaagagcaaaacaaaagtaagaaaaaggcacagcaagcagcagctgacacaggaaacaacagccaggtcagccaaaattaccctatagtgcagaacctccaggggcaaatggtacatcaggccatatcacctagaactttaaatgcatgggtaaaagtagtagaagagaaggctttcagcccagaagtaatacccatgttttcagcattatcagaaggagccaccccacaagatttaaataccatgctaaacacagtggggggacatcaagcagccatgcaaatgttaaaagagaccatcaatgaggaagctgcagaatgggatagattgcatccagtgcatgcagggcctattgcaccaggccagatgagagaaccaaggggaagtgacatagcaggaactactagtacccttcaggaacaaataggatggatgacacataatccacctatcccaaccgtccatgaagggttcgatggcgaccctcggccgtggactatggcaacggcagattcgttaaatgaatttgccaggaagatggaaaccaaaaatgatagggggaattggaggttttatcaaagtaagacagtatgatcagatactcatagaaatctgcggacataaagctataggtacagtattagtaggacctacacctgtcaacataattggaagaaatctgttgactcagattggctgcactttaaattttcccattagtcctattgagactgtaccagtaaaattaaagccaggaatggatggcccaaaagttaaacaatggccattgacagaagaaaaaataaaagcattagtagaaatttgtacagaaatggaaaaggaaggaaaaatttcaaaaattgggcctgaaaatccatacaatactccagtatttgccataaagaaaaaagacagtactaaatggagaaaattagtagatttcagagaacttaataagagaactcaagatttctgggaagttcaattaggaataccacatcctgcagggttaaaacagaaaaaatcagtaacagtactggatgtgggcgatgcatatttttcagttcccttagataaagacttcaggaagtatactgcatttaccatacctagtataaacaatgagacaccagggattagatatcagtacaatgtgcttccacagggatggaaaggatcaccagcaatattccagtgtagcatgacaaaaatcttagagccttttagaaaacaaaatccagacatagtcatctatcaatacatggatgatttgtatgtaggatctgacttagaaatagggcagcatagaacaaaaatagaggaactgagacaacatctgttgaggtggggatttaccacaccagacaaaaaacatcagaaagaacctccattcctttggatgggttatgaactccatcctgataaatggacagtacagcctatagtgctgccagaaaaggacagctggactgtcaatgacatacagaaattagtgggaaaattgaattgggcaagtcagatttatgcagggattaaagtaaggcaattatgtaaacttcttaggggaaccaaagcactaacagaagtagtaccactaacagaagaagcagagctagaactggcagaaaacagggagattctaaaagaaccggtacatggagtgtattatgacccatcaaaagacttaatagcagaaatacagaagcaggggcaaggccaatggacatatcaaatttatcaagagccatttaaaaatctgaaaacaggaaagtatgcaagaatgaacgaatctgccgttgccatatacagcatctgaacaagctgatcgaacccttcatggacggttaaggccgcctgttggtgggcggggatcaagcaggaatttggcattccctacaatccccaaagtcaaggagtaatagaatctatgaataaagaattaaagaaaattataggacaggtaagagatcaggctgaacatcttaagacagcagtacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggaaaggaccagcaaagctcctctggaaaggtgaaggggcagtagtaatacaagataatagtgacataaaagtagtgccaagaagaaaagcaaagatcatcagggattaaccgtccatgaagggttcgattatctgtagccaacattcgatatggcaacggcagattcgttggagatgggggtggaaatggggcaccatgctccttgggatattgatgatctgtagtgctacagaaaaattgtgggtcacagtctattatggggtacctgtgtggaaggaagcaaccaccactctattttgtgcatcagatgctaaagcatatgatacagaggtacataatgtttgggccacacatgcctgtgtacccacagaccccaacccacaagaagtagtattggtaaatgtgacagaaaattttaacatgtggaaaaatgacatggtagaacagatgcatgaggatataatcagtttatgggatcaaagcctaaagccatgtgtaaaattaaccccactctgtgttagtttaaagtgcactgatttgaagaatgatactaataccaatagtagtagcgggagaatgataatggagaaaggagagataaaaaactgctctttcaatatcagcacaagcataagagataaggtgcagaaagaatatgcattcttttataaacttgatatagtaccaatagataataccagctataggttgataagttgtaacacctcagtcattacacaggcctgtccaaaggtatcctttgagccaattcccatacattattgtgccccggctggttttgcgattctaaaatgtaataataagacgttcaatggaacaggaccatgtacaaatgtcagcacagtacaatgtacacatggaatcaggccagtagtatcaactcaactgctgttaaatggcagtctagcagaagaagatgtagtaattagatctgccaatttcacagacaatgctaaaaccataatagtacagctgaacacatctgtagaaattaattgtacaagacccaacaacaatacaagaaaaagtatccgtatccagaggggaccagggagagcatttgttacaataggaaaaataggaaatatgagacaagcacattgtaacattagtagagcaaaatggaatgccactttaaaacagatagctagcaaattaagagaacaatttggaaataataaaacaataatctttaagcaatcctcaggaggggacccagaaattgtaacgcacagttttaattgtggaggggaatttttctactgtaattcaacacaactgtttaatagtacttggtttaatagtacttggagtactgaagggtcaaataacactgaaggaagtgacacaatcacactcccatgcagaataaaacaatttataaacatgtggcaggaagtaggaaaagcaatgtatgcccctcccatcagtggacaaattagatgttcatcaaatattactgggctgctattaacaagagatggtggtaataacaacaatgggtccgagatcttcagacctggaggaggcgatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctgatatagtgcagcagcagaacaatttgctgagggctattgaggcgcaacagcatctgttgcaactcacagtctggggcatcaaacagctccaggcaagaatcctggctgtggaaagatacctaaaggatcaacagctcctggggatttggggttgctctggaaaactcatttgcaccactgctgtgccttggaatgctagttggagtaataaatctctggaacagatttggaataacatgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaatcccgaggggacccgacaggcccgaaggaatagaagaagaaggtggagagagagacagagacagatccattcgattagtgaacggatccttagcacttatctgggacgatctgcggagcctgtgcctcttcagctaccaccgcttgagagacttactcttgattgtaacgaggattgtggaacttctgggacgcagggggtgggaagccctcaaatattggtggaatctcctacagtattggagtcaggaactaaagaatagtgctgttaacttgctcaatgccacagccatagcagtagctgaggggacagatagggttatagaagtattacaagcagcttatagagctattcgccacatacctagaagaataagacagggcttggaaaggattttgctataagatgggtggcaagtggtcaaaaagtagtgtgattggatggcctgctgtaagggaaagaatgagacgagctgagccagcagcagatggggtgggagcagtatctcgagacctagaaaaacatggagcaatcacaagtagcaatacagcagctaacaatgctgcttgtgcctggctagaagcacaagaggaggaagaggtgggttttccagtcacacctcaggtacctttaagaccaatgacttacaaggcagctgtagatcttagccactttttaaaagaaaaggggggactggaagggctaattcactcccaaagaagacaagatatccttgatctgtggatctaccacacacaaggctacttccctgattggcagaactacacaccagggccaggggtcagatatccactgacctttggatggtgctacaagctagtaccagttgagccagataaggtagaagaggccaataaaggagagaacaccagcttgttacaccctgtgagcctgcatggaatggatgaccctgagagagaagtgttagagtggaggtttgacagccgcctagcatttcatcacgtggcccgagagctgcatccggagtacttcaagaactgctgacatcgagcttgctacaagggactttccgctggggactttccagggaggcgtggcctgggcgggactggggagtggcgagccctcagatgctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagca

SEQ ID NO: 117 - DNA, 27 bp, Artificial Sequence
  Synthetic Sequence
  Misc_feature (1)..(1): There is a phosphate group at the 5' end
ctgtctcttatacacatctgcggccgc

SEQ ID NO: 118 - DNA, 36 bp, Artificial Sequence
  Synthetic Sequence
  Misc_feature (1)..(1): There is a phosphate group at the 5' end
ctgtctcttatacacatctttaattaattcgctacc

SEQ ID NO: 119 - DNA, 20 bp, Artificial Sequence
  Synthetic Sequence
ccgtccatgaagggttcgat

SEQ ID NO: 120 - DNA, 20 bp, Artificial Sequence
  Synthetic Sequence
acgaatctgccgttgccata

SEQ ID NO: 121 - DNA, 60 bp, Artificial Sequence; identical to SEQ ID NO: 9
  Synthetic Sequence
  Misc_feature (21)..(40): n is a, c, g, or t

SEQ ID NO: 122 - DNA, 24 bp, Artificial Sequence
  Synthetic Sequence
tctagagtcgacctgcaggcatgc

SEQ ID NO: 123 - DNA, 24 bp, Artificial Sequence
  Synthetic Sequence
ccgggtaccgagctcgaattcact

SEQ ID NO: 124 - DNA, 20 bp, Artificial Sequence
  Synthetic Sequence
gagacagggcaagaaacagc

SEQ ID NO: 125 - DNA, 20 bp, Artificial Sequence
  Synthetic Sequence
aacaggcggccttaactgta

SEQ ID NO: 126 - DNA, 22 bp, Artificial Sequence
  Synthetic Sequence
tcctgctcaacttcctgtcgag

SEQ ID NO: 127 - DNA, 22 bp, Artificial Sequence
  Synthetic Sequence
caggtcaaacctcctaggaatg

SEQ ID NO: 128 - DNA, 21 bp, Artificial Sequence
  Synthetic Sequence
agtgtaaagcctggggtgcct

SEQ ID NO: 129 - DNA, 21 bp, Artificial Sequence
  Synthetic Sequence
tgactgggaaaaccctggcgt

SEQ ID NO: 130 - DNA, 20 bp, Artificial Sequence
  Synthetic Sequence
attgcgttgcgctcactgcc

SEQ ID NO: 131 - DNA, 19 bp, Artificial Sequence
  Synthetic Sequence
gcccttcccaacagttgcg

SEQ ID NO: 132 - DNA, 60 bp, Artificial Sequence
  Synthetic Sequence
ttgtaaaacgacggccagtgaattcgagctcggtacccggaggcctccacctgggtcttg

SEQ ID NO: 133 - DNA, 81 bp, Artificial Sequence
  Synthetic Sequence
gcggccgcaggcgattaagttgggtaacgccagggttttcccagtcacggcgcgccttgtaaaacgacggccagtgaattc

SEQ ID NO: 134 - DNA, 48 bp, Artificial Sequence
  Synthetic Sequence
gcggccgcaggccctgcatgcactggatgcaatctatcccattctgca

SEQ ID NO: 135 - DNA, 48 bp, Artificial Sequence
  Synthetic Sequence
gcggccgctgcagaatgggatagattgcatccagtgcatgcagggcct

SEQ ID NO: 136 - DNA, 48 bp, Artificial Sequence
  Synthetic Sequence
gcggccgcagctgtccttttctggcagcactataggctgtactgtcca

SEQ ID NO: 137 - DNA, 48 bp, Artificial Sequence
  Synthetic Sequence
gcggccgctggacagtacagcctatagtgctgccagaaaaggacagct

SEQ ID NO: 138 - DNA, 73 bp, Artificial Sequence
  Synthetic Sequence
cattaggcaccccaggctttacactggcgcgccatcttgtattactactgccccttcacctttccagaggagc

SEQ ID NO: 139 - DNA, 48 bp, Artificial Sequence
  Synthetic Sequence
gcggccgcgtgagttagctcactcattaggcaccccaggctttacact

SEQ ID NO: 140 - DNA, 88 bp, Artificial Sequence
  Synthetic Sequence
aggcgattaagttgggtaacgccagggttttcccagtcacggcgcgccgctcctctggaaaggtgaaggggcagtagtaatacaagat

SEQ ID NO: 141 - DNA, 88 bp, Artificial Sequence
  Synthetic Sequence
gtgagttagctcactcattaggcaccccaggctttacactggcgcgcccatttaccaatactacttcttgtgggttggggtctgtggg

SEQ ID NO: 142 - DNA, 73 bp, Artificial Sequence
  Synthetic Sequence
gtaacgccagggttttcccagtcacggcgcgcccccacagaccccaacccacaagaagtagtattggtaaatg

SEQ ID NO: 143 - DNA, 48 bp, Artificial Sequence
  Synthetic Sequence
gcggccgcaggcgattaagttgggtaacgccagggttttcccagtcac

SEQ ID NO: 144 - DNA, 48 bp, Artificial Sequence
  Synthetic Sequence
gcggccgcgcacaggctccgcagatcgtcccagataagtgctaaggat

SEQ ID NO: 145 - DNA, 48 bp, Artificial Sequence
  Synthetic Sequence
gcggccgcatccttagcacttatctgggacgatctgcggagcctgtgc

SEQ ID NO: 146 - DNA, 48 bp, Artificial Sequence
  Synthetic Sequence
gcggccgcgcagctctcgggccacgtgatgaaatgctaggcggctgtc

SEQ ID NO: 147 - DNA, 48 bp, Artificial Sequence
  Synthetic Sequence
gcggccgcgacagccgcctagcatttcatcacgtggcccgagagctgc

SEQ ID NO: 148 - DNA, 60 bp, Artificial Sequence
  Synthetic Sequence
tgattacgccaagcttgcatgcctgcaggtcgactctagagcgcgatcttggctcactgc

SEQ ID NO: 149 - DNA, 81 bp, Artificial Sequence
  Synthetic Sequence
gcggccgcgtgagttagctcactcattaggcaccccaggctttacactggcgcgcctgattacgccaagcttgcatgcctg

SEQ ID NO: 150 - DNA, 22 bp, Artificial Sequence
  Synthetic Sequence
gcatccagtgcatgcagggcct

SEQ ID NO: 151 - DNA, 28 bp, Artificial Sequence
  Synthetic Sequence
ctggcagcactataggctgtactgtcca

SEQ ID NO: 152 - DNA, 28 bp, Artificial Sequence
  Synthetic Sequence
tggacagtacagcctatagtgctgccag

SEQ ID NO: 153 - DNA, 29 bp, Artificial Sequence
  Synthetic Sequence
ctactgccccttcacctttccagaggagc

SEQ ID NO: 154 - DNA, 29 bp, Artificial Sequence
  Synthetic Sequence
gctcctctggaaaggtgaaggggcagtag

SEQ ID NO: 155 - DNA, 28 bp, Artificial Sequence
  Synthetic Sequence
ctacttcttgtgggttggggtctgtggg

SEQ ID NO: 156 - DNA, 28 bp, Artificial Sequence
  Synthetic Sequence
cccacagaccccaacccacaagaagtag

SEQ ID NO: 157 - DNA, 28 bp, Artificial Sequence
  Synthetic Sequence
ggctccgcagatcgtcccagataagtgc

SEQ ID NO: 158 - DNA, 28 bp, Artificial Sequence
  Synthetic Sequence
gcacttatctgggacgatctgcggagcc

SEQ ID NO: 159 - DNA, 26 bp, Artificial Sequence
  Synthetic Sequence
ggccacgtgatgaaatgctaggcggc

SEQ ID NO: 160 - DNA, 26 bp, Artificial Sequence
  Synthetic Sequence
gccgcctagcatttcatcacgtggcc

SEQ ID NO: 161 - DNA, 22 bp, Artificial Sequence
  Synthetic Sequence
tgggacagctacaaccatccct

SEQ ID NO: 162 - DNA, 20 bp, Artificial Sequence
  Synthetic Sequence
gctgctgcttgctgtgcctt

SEQ ID NO: 163 - DNA, 58 bp, Artificial Sequence
  A synthetic sequence
tagggataacagggtaatttagttagttagttaactataacggtcctaaggtagcgaa

SEQ ID NO: 164 - DNA, 59 bp, Artificial Sequence
  A synthetic sequence
ttcgctaccttaggaccgttatagttaaactaactaactaaattaccctgttatcccta

SEQ ID NO: 165 - DNA, 60 bp, Artificial Sequence
  A synthetic sequence
  misc_feature (1)...(60): n = A,T,C or G
acgaatctgccgttgccatannnnnnnnnnnnnnnnnnnnatcgaacccttcatggacgg

SEQ ID NO: 166 - DNA, 45 bp, Artificial Sequence
  A synthetic sequence
  misc_feature (1)...(45): n = A,T,C or G
acacgacgctcttccgatctnnnnnccgtccatgaagggttcgat

SEQ ID NO: 167 - DNA, 46 bp, Artificial Sequence
  A synthetic sequence
  misc_feature (1)...(46): n = A,T,C or G
acacgacgctcttccgatctnnnnnnccgtccatgaagggttcgat

SEQ ID NO: 168 - DNA, 47 bp, Artificial Sequence
  A synthetic sequence
  misc_feature (1)...(47): n = A,T,C or G
acacgacgctcttccgatctnnnnnnnccgtccatgaagggttcgat

SEQ ID NO: 169 - DNA, 59 bp, Artificial Sequence
  A synthetic sequence
  misc_feature (1)...(59): n = A,T,C or G
acgaatctgccgttgccatannnnnnnnnnnnnnnnnnnnatcgaaccctcatggacgg

SEQ ID NO: 170 - DNA, 44 bp, Artificial Sequence
  A synthetic sequence
  misc_feature (1)...(44): n = A,T,C or G
gacgtgtgctcttccgatctnnnnnacgaatctgcgttgccata

SEQ ID NO: 171 - DNA, 47 bp, Artificial Sequence
  A synthetic sequence
  misc_feature (1)...(47): n = A,T,C or G
gacgtgtgctcttccgatctnnnnnnacgaatctgccggttgccata

SEQ ID NO: 172 - DNA, 47 bp, Artificial Sequence
  A synthetic sequence
  misc_feature (1)...(47): n = A,T,C or G
gacgtgtgctcttccgatctnnnnnnnacgaatctgccgttgccata

SEQ ID NO: 173 - DNA, 57 bp, Artificial Sequence
  A synthetic sequence
aatgatacggcgaccaccgagatctacactctttccctacacgacgtcttccgatct

SEQ ID NO: 174 - DNA, 113 bp, Artificial Sequence
  A synthetic sequence
  misc_feature (1)...(113): n = A,T,C or G
acacgacgctcttccgatctnnnnnnnccgtccatgaagggttcgatnnnnnnnnnnnnnnnnnnnntatggcaacgcagattcgtnnnnnnnagatcggaagagcacacgtc

SEQ ID NO: 175 - DNA, 114 bp, Artificial Sequence
  A synthetic sequence
  misc_feature (1)...(114): n = A,T,C or G
gacgtgtgctcttccgatctnnnnnnnacgaatctgccgttgccatannnnnnnnnnnnnnnnnnnnatcgaacccttcatggacggnnnnnnnagatcggaagagcgtcgtgt

SEQ ID NO: 176 - DNA, 63 bp, Artificial Sequence
  A synthetic sequence
caagcagagacggcatacgagatcaggttgtgactggagttcagacgtgtgctcttccgatct

SEQ ID NO: 177 - DNA, 33 bp, Artificial Sequence
  A synthetic sequence
acactctttccctacacgacgctcttccgatct

SEQ ID NO: 178 - DNA, 197 bp, Artificial Sequence
  A synthetic sequence
  misc_feature (1)...(197): n = A,T,C or G
aatgatacggcgaccaccgagatctacactctttccctacacgacgctcttccgatctnnnnnnnccgtccatgaagggttcgatnnnnnnnnnnnnnnnnnnnntatggcaacggcagattcgtnnnnnnnagatcggaagagcacacgtctgaactccagtcacaacctgatctcgtatgccgtctttctgcttg

SEQ ID NO: 179 - DNA, 196 bp, Artificial Sequence
  A synthetic sequence
  misc_feature (1)...(196): n = A,T,C or G
caagcagaagacggcatacgagatcaggtgtgactggagttcagacgtgtgcttcttccgatctnnnnnnnacgaatctgccgttgccatannnnnnnnnnnnnnnnnnnnatcgaacccttcatggacggnnnnnnnagatcggaagagcgtcgtgtagggaaagagtgtagatctcggtggtcgccgtatcatt

SEQ ID NO: 180 - DNA, 32 bp, Artificial Sequence
  A synthetic sequence
gatcggaagagcacacgctgaactccaatcac

SEQ ID NO: 181 - DNA, 35 bp, Artificial Sequence
  A synthetic sequence
gtgactggagttcagacgtgtgctcattccgatct

What is claimed is:

1. A method of generating and identifying a defective interfering particle (DIP), comprising:
   (a) inserting a target sequence for a sequence specific DNA endonuclease into a population of circular target viral DNAs, each comprising a viral genome, to generate a population of sequence-inserted viral DNAs;
   (b) contacting the population of sequence-inserted viral DNAs with the sequence specific DNA endonuclease to generate a population of cleaved linear viral DNAs;
   (c) contacting the population of cleaved linear viral DNAs with an exonuclease to generate a population of deletion DNAs;
   (d) circularizing the deletion DNAs to generate a library of circularized deletion viral DNAs; and
   (e) sequencing members of the library of circularized deletion viral DNAs to identify defective interfering particles (DIPs).

2. The method of claim 1, comprising, prior to step (a), circularizing a population of linear DNA molecules to generate said population of circular target viral DNAs.

3. The method of claim 2, wherein the population of linear DNA molecules comprises one or more PCR products, one or more linear viral genomes, and/or one or more restriction digest products.

4. The method of claim 1, wherein the method comprises inserting a barcode sequence prior to or simultaneous with step (d).

5. The method of claim 1, further comprising (i) introducing members of the library of circularized deletion viral DNAs into mammalian cells; and (ii) assaying for viral infectivity.

6. The method of claim 1, further comprising:
   (i) generating from the library of circularized deletion viral DNAs, at least one of: linear double stranded DNA (dsDNA) products, linear single stranded DNA (ssDNA) products, linear single stranded RNA (ssRNA) products, and linear double stranded RNA (dsRNA) products.

7. The method of claim 6, further comprising, after step (i):
   (ii) introducing said linear dsDNA products, linear ssDNA products, linear ssRNA products, and/or linear dsRNA products into mammalian cells; and
   (iii) assaying for viral infectivity.

8. The method of claim 1, wherein the method comprises, after step (d),
   (i) infecting mammalian cells in culture with members of the library of circularized deletion viral DNAs at a high multiplicity of infection (MOI),
   (ii) culturing the infected cells of (i) for a period of time ranging from 12 hours to 2 days,
   (iii) adding naive cells to the culture, and
   (iv) harvesting virus from the cells in the culture of (iii).

9. The method of claim 1, wherein the method comprises, after step (d),
   (i) infecting mammalian cells in culture with members of the library of circularized deletion viral DNAs at a low multiplicity of infection (MOI),
   (ii) culturing the infected cells of (i) in the presence of an inhibitor of viral replication for a period of time ranging from 1 day to 6 days,
   (iii) infecting the cultured cells of (ii) with functional virus at a high MOI,
   (iv) culturing the infected cells of (iii) for a period of time ranging from 12 hours to 4 days, and
   (v) harvesting virus from the cultured cells of (iv).

* * * * *